United States Patent 10,407,724 (METHODS AND COMPOSITIONS FOR SCREENING AND TREATING DEVELOPMENTAL DISORDERS) - sequence listing, part 33

SEQ ID NO: 630 - DNA, 1941651 bp, Homo sapiens
ttctcaagcacgacacagtaaattcagtgataatcaagatccatcaaggcaaatatttccctccagggatttagtaagcaattaagcaaaatcactgctttgagcacttatgtaatattagcgatttcttggtcctcttgacattatattcgtctttagcaattggttcagcaggtctcctaaatctcttctctcatggagcattcaaaattctgtcctagtagctaacgctaaaattaggtgacatcattggcaatactccctggacccccagactctgctgaggtatagaaacatggccaggttggtccttagtctggggtctttgggtcatgggatatgtttagggatagtgtgatttttgacacagaaagaaagaaaaatctgcagttgatttttcaatcgcaaggtagctgctaaaatagtgcatgtctacctgaataaaatttaaagatatactgaaagaaaaataataaaatagtaatatttagttaattttatatattcatttcccaatctactttcattggaattacatataaacataaataaattccttaagccaatattcgaaggttctattcattttcttttctaagaaatgtattgacataaataaaactgtgctatttagaaaaagtacttatggattcaattgatttggctctattcttcccaccagttttttttttaagaaggcagctcatttatgtggtgatgtagcagttcgtgtcacaagcaaattaaaataaaaaatgtccacttctagaaatttttcttttatggtctgagtcagccataaccacagaggatccatcttgtgcaatactgttttaaaaattcattcaattatatttggccaaatacaaaatattaacttgagttacattgagtatttaatagttagcaaaacttatatccattgatatcgaatgctctctgccaaacatgtatggtcttgttttcatttgccctccaaggttaaatgctttgttctaataaagtgttcaaacacagaataaatcaggtattagctgtcagttaaattagtggcaaaattgacaagcagtaattcttgaccagagtttgtatttgttcatcactggttcaaatgttttttatttctttctatattctgcacttatattcttgcccaaagacattttcctctcttggaaaatcataattagtttatttattttcaaaggttagaaacccacagaatcatgattaatgatgtggaaattaaatacatacaggtactgttgccttttgcaagacacttcatggttaatgagtgctggtttgtattctcttcattcagacagtaaagtcagctttaaatgcgtcagtgtggcgagttgatgacaattgctgagctgagtgagaggcatggtttggaaattctctttgttctttgcggctctgtcctgtgacactgccattatcctttcgagtggaggctgggataatgggccttagagagggtgacctggtatagcttgacctgcacaaatgtgtttgtctttattcacttgggccctttgacatgctcttctagatattatgatgttggtgttatattggaatggaaggatttgattactcagggatcaatagctactctggacattttttgaaacacgttgagcatgacaaacttgccatttttgccttcctccatttttagacacatgactctattaagggaaatttaatccgtatgtttctgattcccttacacttaactcatcaaaatgttgttttgtaagaacactttgaagtcagggaagccttttaagtcattttttatgagactttttcaagcctcttttcttaggaacaggaagtggcatttagccaacagttaacaaactcaaacaccaaaaggttgaagttgggtttgaatctctgaacccataagtgtttgaatggactcttgacatgagccatcctactgtgtattagtgccaacggccatcagaaccgtcttgattgctgagatgactccaggaccccaaccaaccgccaacttgtgtttccctaatcagtctacttcatgctgaattatgactcatttaactttaaaggaactactttattacccattctgctgagcatttttgtgacttctgtgagagctattgaatttggcactgtcccacagctagctagatataacttttgaatccagtcaccagtaaaatcacacaagagttcaagttcacaggacaagtgagtgttgattgaccatgaaggcttctacccacaaatacacagaaattatttcagcgactcagtttcctagtggagaagataacatggacgttttagaaaataaaatgcatgttaaaataacaaatgaggcatctggcttcagaagttttcgtttgatttatactcaacagttgttgtaagtaaaaactaagctccatttcccaggaaatttatagcttagacaagcaccagcgttgtcacggtggttcccactgcagaatgcactggaagtgatttcttcctgtaggttttcagaggatcctactaagtcctaattctgcaccttgcaaattatgcaacaataaatgccaaatagcaacagctgatctaggttaaaagatttaaagaagtttcaaaggtagcctaggagaaacagtgagaaataattctagaaacaagagagttccgataataaacactcaagtgaagagagctcaggcaggcagaatgctactcctctcctttagggcactgcaagtcagcgctctgtagacagcatttattatctaggtgaaaaagcctggggacgtggtacaggccacccctctacagatatatcaggattgcatagtggctgcatgcccaggggctctggagtcagactgcctggtggtttagagccagactgtatcactggatctgtgctcttggataaacgagacaaattataggacctgtttaattgggctgttgtgaggattaaagaggatgctacatgtgaaagtcctggtagagtcttgataaatattagcgtgatgaggatgtggttggctaggactagggaatagtataacaagggcgcaatcgctccggtgtaagttaaacactgggaattatgagcatctcatgttctttcatcttcctagaaatccgcagctatgtccaaggctttaagtgacagttgtttcttgatgactctcaaatcaatgtccttcctctagatctctctctgagcaaggcctacaaggccactaccagcctaaccttcagctcttctcactgaactactggccctttctgcagctggaatgttcgtttcatgctccgtaactttgcatgtgctgttcccgccgtcattagtacccctacttcttgtccatctggcacattgctgctcatccttccgtgctcaagcaccatgtcctctgcaaaagcctctgacttccttttgctgatttaagcgttcctctctttacgcgtttatggcactctctcgcatttccttatagctctcatgaagtgacactggaaatcgtgtgtgtgcctgtctccacactcccctgtgagcactgtcagggcaggggctgtgtcttgcatctttgggtgccagtcctaacacagcattttgcatagggaggacactcaatgcaattttggtgaaggaataaagtgtgtctagagaaacagcaggaaggttaggtgggctgaaaatgattttggttttatcagcaccacttttactatagtagactcgacgccgtgtctcatttcttcttgtgctcacatctagcaaatttgagtgtcctggaaatagttttcagggtgagttttatctttctctatgaaagatgtgcaacaatgctctatgaaggaaaggcgcacattgagtttctgatatgatctatagagtgtcatcacccagattccaagcagccccatcaggacagagcctcttcttgttagatcagtgcctgccatggaggagacacacagtatttgatgaatggttgcatgaaagccaagaataaacagtacctggataatgaaaatgaaagcaccactgctccacccacatcttgaggtatttgctttagttccctagagggatttttcagtccttagagtgactcaattgtgtttaacatcagtcctatcgaataccaacatcaagactatttttttcttctcattgctaatgatattgctacattgtcttcaccattgtgaaacttgctgagaaacttgtatataaccttcaaaacccaagtatgtgtgccctgcgaagactgcatgtcactagctatgagtgactgatgtgcgtgacaaggggtgccgaaagccgagcgatgccctgctgtgaagaaccgtgggctctggctggttacagagctgccgtgtgaacttcaaacccatctgaagccatcacaacctttattcttttacccagaactggtgaaaccattgtaatctttattcttttacctagccctggaaggtctagaagtcagtcacttgctgagagatgttgagatgctgttcctccatggatcttctgcaccagaaatacgacttaagacctctctgccacactctgcaatcattcctccttcctcatgcctggctaaggtggtcctcaggggtcattttcaaactgttggtcacaacctcttcattggtctgaaattaatctagtaggttgcaaacagcactcaaaaaggagatagactagaacagaccagtatattttacatagtaaggctaagtgttatttcatgaaagtttttttttggttttcaaaacacacctctctctctgtggtgtggtgtgtgtactgggtactgatagaaaatttatttcttactctgggttgcagtaaaagcagtttgaaagctcctaccttggaaactctgaagcagcctggggtttggatgtggatcagggagtcacaaccatgctgtaaagccaaacagctaacctgtgacactgctgggcacagactgaggtatgtctcgtggctgttaccgatgccaactctcaggattcatacaaatggaagacaagaatatcttaggtaatctacaaatccccaggtctgatttaactcacctttctcccttactttgagaaacatctgttgcatatctagcatgcgccgggcagttctagatgctgggaagatagtgtgaaagtcaatccttgccctccctcatggaacagaagatgcttcctacaaaaagtcttacaattctgagtaactaagttaactggtttattttattgcctccttttccccagcctgtcagtcttttctgataaaaaggctaataaacagaaaccagttaaatagcaaccagaggaaaagaacaggaaaaaaaatcgagtctgaataacacataattagccccttgatatttgaggcaataggggaaataataatgtcatatacatgattaacttctaaagttggctaaaaaaaataaaggaaaaaacaaaaaaccctcagttctatctatgagcccagcatgtccagagtattgtcggagtggctgttgtctttgggtatcctgaattttcttcctagaaaggaagaagaaggcccccatttagttttgttgcaggtttcaaattcttctctgggagaaaagctaatgcagcaagttattttttccctggctatttatttttccatttccagtcgctctatgctagattgtaacattcagggattggggagtacaatcgcttcagaataatcagtcataaacattccaggtttagttaactattaaggaaagcagcgtctttactttttaaagaggaaaaagaaagaacgtatgccacggcctgtaaaagactttcccatgttttgtttacattggaatttcaaaagctgacaatatctttccttccttcctgctccttgatgtagtgaaaggtcttccctgtaagtctgatcattttagttgaaagtgtttagactatctcgtgtactcaagtactcatcacgatagaattccaccgtgtaagggcttggtggcttctaagctcatattttctttctttcttttctctcaacaaactcaactatcattgtcatttaactttaggctccatcccacattcctgcaggaaatcttcttttaaacagaattatatactgcaggaatggagctgctcaattttcactgggttgcattttttatggttgttcctttacttcctggtagcatatttctgatgacacatccgtagcaacagtagttttatttataagcaaagggaagaagaaacatggactttggctaacctgggtgtacaaagaacacccagaatgtaattgtaattatgtccacttgtggtgatatggtccaaggtttatcaggatttccaaaggaatctgtgggaggaaatctaccagtgatcacagccataatgaaacaaactgatgtggaaatttctattctttaaaacctattttaaatttagtgtttacaaataggtataagttagcaagagtgctgaactcaggggacgatctaaatccactcaataattagttcaacaaacttaggctaggcacagtggctcacgcctgtagtcccagcactttgggaggccgaggagggtggatcacctgaggtcaggagctcgagaccagcctgaccaacatggagaaaccctgtctctactaaaaatataaaattatccgggcatggtggtgcacacctgtagtccaagctactcaggaggctgaggcaggaaaatcacttgaactcaggaggtggaggttggggtgagccgagatcatgccattgcactccagcctgggcaacaagagtgaaactccatctcagaataataataaaaaataaataaataaatgaataaataaatacagtcatgggacccaacattacagactttagtcattgacgttacagaattgagccactcatagacagggacatcacagagtttagaagaaacagagaagtgggaggggacagagtcagcagatgtgcctcaagcagagggttcgggggagtgtcggatgagaaagaagagctggaaaaaaatgttaagaaggagtagctggagatgttacaagaaaataaggggtgcttatcatcatagaagccaataagataatttgaaaaatatagcggttacaagagtcaaatgctaaacggttccgaatgcgtgagggttgggatcaggactggcgattagcaagttttatgtggcttttaagccattactttctgtagaaagagaagagcacagccagaggatagaattgaatgggaagtaaagatgaagtaaaatgagcgtagagtgtattttttctcgacaattattggtgtatggaagcatgtagataaatagttccctgaaaatatcgtttacaggggtgcttttatttctttggatgaggaaactacagtacattataggacaagtgaaaggagcaagtagagaaacagggtaatgatgactttagggaaagataaagaggggtctcaacagttcagaaggagcaagtctcggaaaagaagagggacagttgtgtctgtttcacttatgcattgtcatatgacaaatatcctcagaaacttggaggcatggccggacgctgtggttcatagtttataggtgcacagtgactataatcccagcactttgggaggccaaggcagggggattgcttgagcccacgagtttgagaccagtgtgggtaacatggcgaaacactgtctctacaaaaaaaaaaaaattagttggatatgggagcacatgcctgtagtcccagctgcttgaggggctgaggcaggaggattgtttgagcctgggagctctaggctgcagtgagctgtgttcacgccagtgcactctagcctgggtgacaaagtgagacctgtctcaaaacaaaacagaagccccacaaaacttagaggcttaaacaacaccattttattatttttcacagttctgtgtgttggctgcgctcccctgagatgtcttctctctgctctactcgtctcagctgagcacatctcgagtggcacagtttggagcagaggatctaaggtggttggtctgactccttgactgtgttagcttgggtggctgaaacgccgtggatgctctttcatcccgtagtgtgtctcttcccgtgtggcctttccagcagcatggcccagacctctcacatggtggttcaagtgagagaaggctgcagagtctcttaaggcctaggcactgagactcacgcatcatttctgccatattccaagatcaagtgaaggtactctgcaggtcacagggcagggcagattcaataagaaagagaactaggaaaagcacaaagatgtggccgcataacacattggggccagtttgcaaggatttgccacaatgcttctagaacaaaagagaaggagaaaggattagtgtagatttagaacacttctgaattaagaggaagcaattggagaaagttcaggctgaaaaccttcaattagcatagactgaaaaaagctcatctcttaaaggagaagtcataaaagagtttatatgaatcagagtgtgattcctttttttcttatacaatatgaaataaaaccactctgtaactcttgaataaatctgctgttagggaatgcagcatgctatgagcctgattttaaaagaaattttaatttttttgaataaaatattttaaaaatgcatatgtcacttgcctcttcatatttaatgcacttttagcaaaactcatgttatgaactgagaagggtctgatgttttactcaaattgcaagctaacaaattagtttgctatgattgctggaagaagacatgagacttctgtatcaaagacaaaggattttattattcatagcaatagtagtattcagaatataagcactcttgggccagttccccagccctaatccaccaaggcaatgagaaggtgaccaagtgacatctgaacatacagtgggttgtgttagaaaagaggaagttgaccttgggaaacctgaatcttttgtaattggcacttggcatgcttgctatttgctaggaaggaaatgtcatttttattatactgtacagcatgcatgtatatgtctcttgttgtggagggagatactatctttgtctttcaaggctgtaagcaattttatccattggtccagaaggagatcctatcactgtcttcccatgctatacaaggcctccttgaaaagacagctgagagcaaagatagctagtgcttctgtttgtaagacatgcagaaatgtgagagacccacgaattgtctccccaaaactaattttaaaatatgacttcagtgtgcaagaaatggtcaaaataaaaatctaaataaatttctaccataaagaaatatttcaaaaaaacaaatatttcatatgtaagaggtaatctcatatgtaatttcatatgtaatcttcagtacgtaagtacttaaaaatattctttattttaaaagtattgtatgtttacttatatattcaatgtaagatcaacaaatttttcatgtaggcagtgaaagtacaaacaaataggagtagtaagcagtttggaacactgatttcagtgttcagctccttgatcaagtatttggtgaaatcacaaccaccagggtgtgggtgcgcctgttgggcagcagtgacaaatggccttccctaggatggcctgtagatgtgtccttggctttgctatctggactattgcccatcccagcggcttccctgtacctcttatgaaacaacaggagcctgttaggctttggagtttatctagttttacaaatgttccagaaaatttgctccatcccaggataagctgtggacacataggtaggatcatgatgtggatttatgtttcagatttaccacagagtggtgtgttagaccatttatgctgctgcgacagagtaccacagaatggataatttataaagaaaaaagattgatttgctgtatggttctggaggctgggaagtccatggtcaagaggctgcatctggtgagggccttcttgctgcatcataacatggtggaaagcatcacatggcaagcgagggtgcaagacagagataggaaatcattcaaactcatccttttatcaggagctcacttctatggtaacagcattaatccactcagggggacaggagcctcatgacgtaatcacctcttaaaggtcccacctcttaataccatcacaatggcaattaaatttcaacatgagttttggagggggcattcaagccacagcagatagtattggtctgatgcagtcccaagtgtgatggaatctagagatctcttcaaagtaggagaggaagtttagagtgtccacagaatgcttttgcttcttggtaaagtttgagtacaatacatactaatcattgtgtagctgtcatatttttctaacaacttcaaagacaccaaatctaatttacctgtaagcagagagacacatcctattgtagatttaactttgctcaataggtccttatgagggaggagtgtccattctgtatcactggtgaataagtgagcatatgaagatgaaacgatccacaaggaaggcagggcatggaatggaatttattttattatattttttatttttttgagatggagtcttgctctgtcaccaggctggagtgcagtggcatgatctgggctcattgcaacctctgcatcctgggttcaagcaattctcctgcctcagcctcccaagcagctgggactacaggcatgtgctatcatgcctggctaatttttttgtatttttagtagagacaaggtttcaccatgttggccaggctggtctcgaactcctgacctcaagtaatcctcctgcctcagtctcccaaagtgctgagattgcaggtatgagccactgcacccggccaagaatggaattaagaatgttcagtttcttatttcagccttggaacactaatattaattgaatgtgttgttttctcctaaatttatgtttgtattttttcattggtttagttcagttggaagtgtaatttcacattaacgggggaactaaatcaattacatgtgttcttaatgttccagtagtgtctgcaacttggttaaacactgaagtggtttggaacacggcattagccaatatagccagaaagaaaaagggaagaaatcagtagaaaaaaatgcctatatcaatattaacttctttttcagcattcaatatgcttgactttttctcttatgacaccttaacctcctcctaaatgctagctgtctagacctacttcctatactcctattttcatattactttttgtgtttaaacatttacttcttcactatttatttcctttgcctttctatccactattttcttattctccctttttttcccttcatttaatagtttctgaaaactcatttttatcactgagtgttttttttttagccttttccagaggcagataattaccactagaatgatcaatggctttggagaaatgaattaaaacattagttccatggataaactcatacttaatgttaggagattttgatttccagataggggatttttttttttaatcatctagactactcttggctttccctgctaattcttaagtttgtgtacaatgtccaacctaaccgtgtaggctgattgttgaaaggaacactggtgaacagatccaaatctgtcacactccaggcaaatagcaatggtgacacaaaaatgagaaataggactgctgtggactatttgtgtcaccccaaattcatatttcgaaaccctaatccccaaggtgatggtattaggaggtggggcctttgtgagttgattatgtcatgaaggtgaagccctcatgaatggaattagcgtccttataagagacccctgggagatttctaactcctgccacatgagaacacagcgagaggacagctgtctatgatgcaagaagcaggccctcagcaggcactgtgtctgctgcaccttactcttagacttcccaacttccagaactatgagaaatgaaggctcgttgattataagccatgcagtctatgctattattgttatagcagcctgaatggattgagacaaaaaccctcctcaacagaactttaggctccttagccagtgttatggagctcttttaaaaagcatagaaatcactggcaaagagctcctggcattgagccacgtgacagttagcagaggctgctttctgcttggccagctgtgcaaggagacagagcagggggtcagcagagggagctgaaacagtaagactataagcagaggaagagtggcaggaaagaacaaaactcaattcaaatgttgccagcacacagtgaattgcagggaaccggctatcatgagagagggtcccaggagtacacacatcaaatgtggtttttgaaccagaggacctcctgactgctggtggcaggatgtctctattccatgtagttatcaatgtgttactcttttctttggttgaaaggattttgggtcaggcactgatctttctttgaatatatgtgcctgttggatgcctgaacagtgagaaatgcaggaacgtggtagttagtgatggttaggagagcaggggaaggcacaaaacctgaatgtcacaggaaattgtgcaagtataataaaagtaacagatagcatttattgcttgattgctatctgccaggctcagtgctaggatatggaaatatagagtcacgccaagtaactttggtccctgccctcaagcttagtctgatgcaaatccaccatgaaccagggaattgacaggcactgaaggtaaagccagtgcttcaagacgtcagacaagacaaaatgtcagaaaaacaaacaacagaggaattgctatgggaatcttgaaagaaaagctatttcttctgcagccaagaaggcttctttcaagtaggggtgcagatgtctctcagtggatgtgatataccgaggtcttgcagaatgaagcaagggagagacaaaggggtggggaaagtggccaacctggcgggagaggggagggcagctcaaaacccacccaccggccagacatttactttaggtcaacacctccagccccgtagaggcatactgtgcatgcaaacagacagtgagggtttgattctgaaaacacaaagaacaagtctggctgtaccacacctctccttaatcctcttcatttctcttctcatctcttatttcccgctcagatttgaggctcgtcgtgtctcaagagccatgcttggtgcctaagcagtaaccaagaaatatggactttgctattaaaacagatgttctttagagggtactagaggctgggaagaggaagggaaaagggagatagggagacattctttaaaggataaaaaattacagctagataggatgagtagtcctggtgttccgcaggtctgtaggatgactatagttaacaataatacatgatatgctttcaaatagctagaaggaggatattgaatgttcccaacacagagaaatgacaaatgtttgagaagataaatacactaattaccctgatctgatcactatacattgtatgtatcatcactatgtatcccatgaacattatgtgccaattaaaaaaataaaagaaaatatttttaaaaggggatgctctttgttaagaagagagatggaaatgaaagatgtcagtacagtgcatttaagtactactggaagatgtttaaagcatgacgggatccttgagatggaacgtctaattctaggggggtggattttaaggatgttcaaagagaaggtgacatttacgcagaattttgaaggacaactagtagtttgccaagtatatggttcctggggttcaagggtagctttggagagaggagaaagcattctaagcagataaatagcacatgtgcatgtaaacaagagtggaaatgcatcgggaacccaggacactgcgggactgtggtatggaaagggagagctacaggcagaaatcaggctgaaaggttggggagtgagagggtaataaaggctctgcttgttgcaatgtactcaaatttaggggcgcctgcccaagacatgcctttttacaggggctgcccatcattcacaaccttgctggagatgtgagccaagttaacatgcctgtctctggctgtccctggctagagctgattggacaagggttggttctgtgatcttggaggaatctaacaatagacttggctgaaacaagcgtaagacttgtcttccaaaatatgaactaaaggtctgattggtgtgtgatggatgtgtgagcagaggtaccgagagcaggggctgaagcagctcttctccacctcctgaagtacagctgagcaggtctgtagagagaagcacaggcactcagggaaagtggagacgaggccatgcgagtcatgagtggggcgttggtggtgcacttcctgctttgtgtgccataggatagctctgtagactttcataaataccccttttagggagactccatttgcgttctttgcaaacaaatgcactgctgtaaaatacatgccattctaaagagtttggattttatcctgtcagtatggggaatccatgaaaaatattaagcagggttaacatagattcattgtgttgtcttataaattaacttgactgcaacttgaagaatagttcagagaggagcaaaatcaggagaggaaaacgctaggaggccatgggaacaatctggacaaagcctgacacatccctcagctgaggagaggcctgggggaagagagagtctagatctaaggacatctagagagccccagctgaaggacttgtgaatgagtgttgccgaggctacaggttgggtgggtattggctcgcttgtgggactggcatattggtagacgtggtaaaactttagaaggaaagagatgtgcaagtgaaaaaaatgagattcatttcagagacattgaggcacatacaggatattcttatggagttataggctccaaggaaagttctgggctgccacatgcaaatgggcgttgaaacaatgggtgtgaaagtgattgcctgtgaggagcaagtggaatgtggaacacaaaagtctaaaacagagctgggaagaaggcattcctcaaggagcgggcagaaaaggctgagaaggggtgaattggagaacaaagccagcagagcagcatcagagaaaaaagtgtggtttcaaaagaaagagtcaaatggtgcagcacagtcaatgaatgtaagaggtggattaagacgtttcaaggccatgctggactctggcacaaggcgtgccaggctctaaggcgcaacagcccaggctggccagaggcactgggtttgggagccactgagcagaggtcacctgcggtggcggggcaggggggtgcggggggagccactgtccacagccttgatggccaggaaaggcttttagggatttgttaaacactgtacatattctcaagtctggggactttttaatttctttttttctttttcttttttttttgcagtaggctttttttttaactctgaattttaacaacctaactatctaagagatttaagaactgcagtttttccaggcttatgaaatgcaaaatgttaaacctcccactttgctaatgagagaatacaattactgtctaaccaaaataatttaatggctaagtgagataatttaaaggatctggaagagtcatgaatgcaaataagtgattttctgcaatgtttatctgcccctcccagctgaagtcactgagtataccagcagctgcagatcccactgagcagcgctgacgggatgggatggagcccaggccacctgctggcctgagatgcaaggttccctctggctgcgggtgagccttgggcacagggagtcagcctcctgcaggtggggcctgggcctgtctgatacccacagcctttagtgtctgtcttcagcgcgttttgctctcttttcctacctagactccaagattccttgccacctgtgctcctgccgccgttctccgccatctgataagcactctctgggccctgacactgacctgaactggaccagggttaagcccaagtcgccccgtccttctgggaaggctctgtggagtctcccacatttctctccagctgccttcacctctcccttgctccatggtcttgagggctcagccttccggcccccattcattaaagttcatgattttcaatcacaaagaaatggctactttaccagaaaaagcagtcagtttgcttaggtatttttccagagacaaaatggaagttaaatgaaagaaataaggtatcgcattccacctaagccagtgggtagctttacttgaaaaactgcccgaatgtccctgttttgtcgttgagtgaacagaggagcggatgtgagcatttttcagcagagatgtgctgctttgcagggaacaggcaatatggatgcatgtaaaattcttgcttgaggattaagagtccaaatgtgttttaagaactggctatgcaaaatctcagatataactgataaactgttgtaatctggttggcatatagtcctgtctgtaccacactttttctttccctaaaacacaatttggctttctacttgttgaacaaacagatatggcaaataaaagaaggacaaatgttattgatttttttttttcctgagaaagagtcctgctgtgtggcccaggctggagtgcagtggcgcgatctccgctcacagcaacctctgccttcagcattcaagtgattctcttgcctcagcctcccgagtagctgggattacaggcatgtgccacctcacccagccttatgaagcgatttttacatatgacattagagatatcaaaggggagtgtcttatggtaaaaaagctctacacgtttttaaaaacatgattccactggtatacatttttccaataaaactccaaaattgatcctatcctaggtataatcttatccttcttcacacctctcccatccttaaaaaaactctaagttaattggccttgggaacatttttggtttcaatatttacattaggattttgattttttaaaataattattgatcatttccagtttgaaaatgttaaaaaaaatttttgaacagtaacaaattttaagaggactttttatcccctaaagaaagccagtttatatagaactactgttatgccagtattttaaggtgccaggtatattttctgctctgatgaaatatttaggtaatttctagccagacgagatcaatagaacagggctgtacactttgtcgatattttgagattctttttattcccagaccacaaatggacagaggcagctttgctcttaagaagcgagtatttaaccactaaaaatagcttatagaatgtgaagtcaccaaaaagatatcttgagcatgggaaaaagagagccctgcgatctcccttctgtgataagaaaatttcaaagcacattagggactggaatctatcagacttccattccgtccccagaggtacttattttgggaatgcttacagatgataaaaacatgtttgtacactaactactcaatctccaggctaaatatacagtctacagactgtgttggtggctgcgaaggcatcgttttcctcgcagcaaagccagggctcgattgatggagaaatcagattaggaacctcattagcctttgaaatgcgtggctgtggggcgaggccagactgagggagattcagggaggccagtgagaaaaccaacagctgcaggaagcagtgttcatcaagtggagcacatcttgtgggggttggagtatttggaaagatctcagaagatatgctttccttttcctgtcaccaatgagatatgcctggaattgctcgttttgtatatcttagaatgggaaatgtccagcttacgaattattttgaggttaattgctcttaggagatgtttggctgttgctgcatttttgtagccttcctcttccaaattgacatcaccctttcctacgtagtgggtgagatcctattgtgtctagagatagagacagatcagggctgtctgtggctgggagtgatggcagtctccaaacagagaggggtttctctcgctccctgtcgtcccatctcaggccacaggtgggcagcggagcccagagttaagtgggaagccatgagtgggcagacattagctgtgccttcctctgcctcaggggtcaccatcaggattttcatcattgtactcgcttccctttcgtaccctaccacatccagactggacctgtgatgggagctgaggctccttctgggtctcagtgtgtctgaaacggtcctgtgttgggtgctgggatgatagaaccgacacccagtgagtcctagcagtggaaccacctgccctgctaatcagacaactggaaacaccattccaagtggtttggagagagctgtggctaagtattactgtctttttaaattcaaacgtcgtgttagtttgttttcagtcccctgtagttgtagccttctgaaaataagaggatagcttgttcaattattatggctctaaggagaattgttgtaggaggggaagaattccctgctgaagcctcttggcttacatgtattaatgctaactagtggccctttagggcatacataattgtaaatacagctatgtactgcttaacaagaatactctgagaaatgtgtcattaggtgattttgtcatgcaaacatcatagagtgcacttatacaaacttagatggcatagcctactacacacggaggctgtatggtacagcctgtagatcctgggttacaaacctctacggcacgttaccgtactgaatactgtaacacaatggtaagtatttgtgtatctaaatatatctaaacatagaaaaggtagagtaaaaatacagtatcatcatcttatgggaccaccatcctatgtcgatccattgctgaccaaaatgtcgttatgtggcgcgtgactgtataatcctgtttcacctgtaacagccgtgtgattttgtggctcatatctttatataaatagcaggttagtgcttactggctgtatgtccttgggcagtcacttaatgtttctgagccactgtgtccccacctgtgaatataggagtagcacaccattcaagagttttattagaaatcaagcaatgtgctattatgtttaccgtgtagcaggtatgcaagcagtatacacaattaattattattaattaaatctcaggtgctcctgtaatttactcctgttaatcattactagggaggcttccgtttccgtagttcccaatctttttaaaaattgattgctaatatttgtacatattcacatgggacgtgtgatatttggatacatgcatagaatgtgtaatgatcagggtatttaagataaccatctccctgagcatttatcatttctttatgttgaggatatttcatatcttctcttctagttattttgaaatgtacaataaattattgttaactatagtcaccctactgtgttactggacgctagaatgtatttcttctctctaactgtatgtttgtaccccttaaccagcctcccttcatctctcctgccaccccctttcccagcttcttgtgtcattccactctccacctccatgagatcatctttttttgctcccatatataagtaagaacatgtggtatttgtctttctgtgcctggcctatttctctgaacataatgacctccagttccacccatggtgctgaaaatgacaggatttcattctttattatggctgaataatatttaattgtgtatgtatactccattttctttatccacttgttcgttgatggatacttaggttgattccatgtctttgctattgtgaataatgcggcaataagcatgggggtgcaggtatctctctcttatactgatttcctttcctttggataaattacccactaatgaaattgctatattgtatcgtagttttactttcagtttttttttgagaaatctccattttacataatgactgtactaatttacaatcccaccaacagcatccttgccggtatctattttttggcttcctgttagtagccaatcttactggggcaagacaatcctcattgcggctttgatttgcattttcctggtgactagtgattttgagcattttttcatatacctgtttgtcatttgtatgtcttctttaaagaaatgtctgtttagatcccttgcccatttttagtgggattatttgttgttgttttgttgttgagtaatttgagtttcttgtatattttggatatcagacctttgtcagatgaatagtttgcatatattttcttccactcaagaggttgtgtcttcactctgttggtagtttcctttgttgtgcagaagtttagtttaacatagtttcgtttgtctattttttgtttcctgtacttttaaggtcttagccataaaatctttgcctaaatcaaggtccttgagtgtttctcctgtattttcttctagtagtttcatcctgttgggtcttatatttaagtttttaattcattttgagttgatttttgcatatggtgagagataggggtctagtttcattcttctgcatatgaatgtccagtttttccagcaccatttgttggacagaatgtcctttccccagcatatattcttgatgccttttttcaaaagtcagttggctataagtacatggatttagttctgggttctctattctgttccactggtctatgtgtctttttataccaataccatgctgttttgtttgcagtagccttatagcatattttgaagccaggcagggtgatgcttccagctttgttctttttgctcaggattgctttggctatttgggctcctttttgattccaaacaaattttaagactgttttttctattactgagaaaaatgtcattccagtctgtttatatcctctctcaggctacttcatacatgcctggatttgaatctcgaagcttgtggttcttaagttttttatgtcgaagaatcccctggattgtgtgttaaaatgcatacctcctggcactacctggagaggttctaaatgtaggtttttggtgaggcccagcactgcattgttaagaagcacctcaggtttttttgatccagacaggctgatcacaatttgaaaaataagacccaacatgtgaaattccctgaatacatgagcctttggtttctcatcatttgccacttacctgtcatttattgagcagccaactatgtgcaacatatttttctagggtatttacatacagtatttttttgtcttcataatagtctgatattataatgattagtgtcctggttttacattgaggaaactgaaactggaatgtcccagaaaactccttcactcacatgtctggcctggcctgagatggccgaaaatctgagggctgactagcattgctcattctttattttctgttaatcagtttatatacaacccctaagcaagataatattatgtgttctgaagttcatttatttgcactgctatataatattcattgatttaacataatacctcttgaagagtaaccaaggaccaagaacagtatatgccaagtcagagtttaatttttagagcagcaataccctggagtaagttcagtgagtctctctgaaagctccttccaaatacggtgagattgtaaaaggcacttttggattgactgtgataaggaattgagaagtcgctcttggcaaggatcatcattgcagcctaatgtcttctgcgtgggcattaaagctggcccagttctctacaaggtgtaggatgagtggtagaggctcaagcaggctcagagttaggcaacagtcaaatctgtttgcccatgaacatagctgggcaaaggttctttttaacacatgatcaaattatccattccctttgccaatggacatttgtgttgtttccatttttttttttttgctattaaaaataatgcagctataaacactttggacatgtctccttggagcacttggggatctctctcaagaaaatattcccaggagtggaatatttgggccaccgtgtacgtgggtcatcaagtttcttagataatgctaaattgtttctaaaaagacttgtgtgagtccacactcccaccagcagtatgtaagtaagacctgttgctgtccagtcccacaacagggtgctctttctggtggcagtgaatgaatggatcccttgtgagtcaatttgggatgtgataggagagttaaataaatgcaacattatagaatctgtacagaatcagcatcagggatcttcaggaaggaacttggcttatacatcattttttggtaccaaaatacctcatagaatgctgcaccccgtacattcatatttactgagttatgaaattctagcccatgaaattgcctttctacctggtttgtgtgtttttaaaaatccttaaaaggcttgcatgcattctgtcttctctgaaatacacataattccagtctgtcatataggatttttgtgtgggtttataataatgggtttaatggctaaaaagcataatgcaatgttcatataaataatgaagttggtatatcaaaataaaagtggagagatgctcaaaggctgagttaatgagagaagacaaacacaaaaatctttgactgtcttcaagtacagtaaaatttcagctgtgtcatcactgggggttttcctggatgcggaacagctgtgactgcttcgtgtagcaggtgctggacttcaccggtctctatagtggtagcaaatttgggtcaccgggaaaggcagttcttgctgttcctgtcactttctagccatctgaaaaaatgatacagtgttgttaggatcacagaaggatatggagaacacccaaagtccaaggggcattggccaataagaagacaaatgtgggatttgtcctctttgccactaaattaccagaaagaatgctgctcacgttgatcatgactcagagtcagcgcctcggtgcccgggaggagtctgtgaacttgtgtggtgattcggctctggccctgagggacaaatgtccgcttttgaaaaccaccagccactcagcagccctcacgacggaaccaatcagccactgcatgttcagcagtggagccgattgcaggaagacctctctgggagaataagaataggaccagccaaacttccctttagaaataaaattcagctcaatccaaaacagtcatattgcatttttattatgtccaccacagtgaactggggattgcgggggagacagagaaggaaggcatggctctggcttcaaagacctggtaatcagatgtgttcttcactgaaaaagggaagagaggcagaaagaaggaagccacgtttgctgtcaagccttcaccctaccttgcttgcaaaattataatttacaaatttaacattagtgactttcagaaaaagataggcagcagaaacataggaactggcactttcttagatgtatgttgccgatgaaagagggaaaagatgtagacaagaaatcctctcttaaaatggagagctggggaaaagtcgggtctctcctatcaaagagacaactacaagtgctgcttgcttctgtgtgtttgacaccgcagtcggtgaactgggccaatgtcagcccacagaaattggaacagcctgagtatatctggaagcaaatactccacagatggagagggaagtgggaggttagctcagaccacttgattttacttaaacagctttcaattttgtgaacttggaaaagaaaaggccagcagaactaataaagtccacgtgacatcaattctgtttctttaacacctagataaataacaagtgaagtccactgtcaccaaacatgggacctatgttgcaattccctttcctaaggagggtcgttttctgattgctgggcatgagtatgagtatttgagaggcatcagatcatagaaggaggccttaataattgtgggcatgtacgtgaagaaagggcagatgcagcagtgattatttcctgtttagagatgtttgtcaggacaccttcgagggtgggaacaagtttccacggttagcagaacagatggacggaagggcagctgagccctgcttccacagtggactccagagctcttgggtaacatttaggatgcagccatccagaaacatcgtgaggccaaatgtaggaagatgccaggacccaggtgtacccagcgttggggtgaactagtttgttgcttagaactaaatctaactcaggttctctttctgcagaaggctttacaagaccataagggagaagggagaaggagaggcagtctataattgcctctaccatcttcactcccacccctaaccttactcatgccagccttctcttcccacatcccatacttttcttattcagaattcattagccagaaaatatagtagcagccataactgacattttcatattgacatgtaatgtctaggtcaattctcagccaagtgtgattttacttcccagaggacatttattggtagctagagataactggggttgtcacaactgaggagggggatgctactggcatgtagtggggagaggccagccatgcagctaaatatcctacaaggcacaagacagccccaacatttaagaattattgggcccacaatgtcaatagtgtcatagttaagaaaccctggtctaaggccagacgcagtggctcatgcctgtaatcccagcactttgggaggccgaggcgggtggatcacctgaggtcaggagtttgagaccagcctgaccaacatggagcaaacccatctctactaaatatacaaaattagccgggcgtggtggcacatgactgtaatcacagctgctcaggagtctgaggcaggagaattgcttgaaccccagcggcggaggttgcggtgagccgagatcatgccattgcactccagcctgggcaacaagagcgaaactccatctagaaaaaagcaaaacaaaaccggaaaccctggtccaagataagatgtgaattttgctgagaaaaactggaaaggttgaatggagtcggatcaagttgtgatggtggatctaattttataaagttgattttagactttatttcattggccattaaatattagcaggcagttttagtgatgtttttgtcatcagtgctcttctaacagccctgatgatggatttcctttttataacatgttgcagatcacacttgtgaatcacatcttcattctgtcagttgctgactttgggggaaaggtgagatttcctacctaccttctaatctacattctcttgtttttcctaagtgggtaggatcttgttgtctaatgatcttttttgctcttgaggacatttacatacccagtgagaaacaacaacatactttgcatggccactggtttgatgttcattctcttttaatttatttgaatttaattaagataatcttatttagaactcaactattaacatggcgaatacattggttcagtcgtgtgaaccaacaaaaggtttttttattttttaatttatatatatatatatatatagttttttttattatactttaagttctagggtacatgtgcacaacgtgcaggtttgttacatatgtatacatgtgccatgttggtgtgctgcacccattaactcgtcatttacattaggtatttctcctagtgctatccctcccccctccccccaccccacaacaggccccggtgtgtgatgttccccttcctgtgtccaagtgttctcattgaatgggcaaaagccaacaaaagttttgatgtgaagcctgcagcatgctctccatctgattgtgtttatcttcctttctgatctctcggggtaactaactactgcttctggggcagatggcatgatggcttcttctgctgggctgtgctgcatgacttgagatatgacagaaatctggagatttagtgcagatgcccaaatattagttgacctcgaatataaaacactcttgatgagaagttcctgaagtttttttctttttttgggccatcttgaacatatgaatattgagatttagataaaataatcaatacagttaattaatttaatatttaataaatttagttgtatccataatttaaaattcctttattatctaagataacatttgaacagtatttttttcgacttctcactttggtaaaacaatttagtttggctcatgatgtgtggctctaaataggggatcttcatcatcaccagaactactttctgagctctctcctatgacatttttcccacgtcataatccattgatttttttgagaagtagttttttaaataatatatgtgatgtcattggaaattgtatcccatgctgtagctgcccattcacacaacattaaaaattactttttcattcatctttttacatgcctgtttgcaacattcacttacatgtgtgaggttaaatatctggaggaataatgattataatgattatatctgtttagcgaattctgaagggtgacttttataagcaacaatcaactagcaaagactgaggtcatttcaggatttgtctttcataagccatattttgttgttcataataaagtatctaagatggcatcctttaaggtaaatcattttgtaagatcacaaatggaagacaattactcttttctgaggtacatttttgtttcagatgaaaaactcccaccttaatgtttgaatatgcaaaatatgtaattgtatatttttctattttgattcattaatgttattatgagactttcacttggctttactctgataactcatttattacctgactataactaggatacactaagaaaaatcggatataatagttgaaaactgggctaataaaagattttaattctaagctcagttaagttttgctaaaataattcattgaaagctactaactggattcgccctagttcctgttccaatatctaaactatagaaaaggcttttatttatttcttaaataaaagattcctgaagaatgcccacacaagagaaaccacagagcccagattctccctttgtatgaactcatcctgaaaccacacatttactcccagagaggtaacaatatgtttctgcaatgatatgcaggttaaaaaaaagctttcaggacaaaaaaagaaatgaataaaaaatcaagccaaaacacatggattccaggtgtgcatccaagacagctttttgacagatgtaaatatttcctgagcaattttgctgatcttatgatgtgtatctcacagccatttccataaaaaaatgcaagtgagtcaggatgaaagagacttccacctggacttcaacgtctccagcatttactacctgggtgatcttgaacaagtcacagtttcttttcaattttccttatctctgaggacgcttctcaggctgactgccaacaaatatgtaggaaaacatactcagtacaaaacatctgcctggcacataaacattggttgaaactgattagtaaaagtataaaacttgctgatgacttagtgattattactgctgtcttcaattgccagtaatttatttctactatcttgatggtaaaggcgtgattttttttttttttgaggggctgcaatagtattctctatttataatttgggaaaaattacaaatgtttttgctttcaaaatctggaataacagaggccaggaattgataggccattttagatttttccaagtggagttcttcctggtccagttttcagtggatttggggataaataagtttccctccaggttgtggagtgctttatttcctggaactttttcacatgaagtcatcacttgttctttatttaggtgggcctacggccacatttgaatcagatcagtgtaaactttgactcgtgtactgagacttctggaaaagacagcacactagcttgggagtctgacccccttccttaaactcaacctgaaatgctacataagcaactgggagaatgactgctaacagaatcagtacagctcttgcggtagcagaaggtgttaggtgattttctgggagagagcagcccatacccgaagagaaccagctgtcactaatgaggggacactgtgggaaggagctttctagttgtcctaaggttttcatccttcgttgcctcagagggagcattgttttcccccatccctgcaggtggggaaacacagcatccccaggacggcacatgaggaagagggaggcgacatgcgagtgctgaggaggaaccccggacgccaccatttcacatggaaaaggcaggcaccatgcgagtgctggagaggaaccccggacgccaccatttcacatggaagaggcaggtgatatgcgagtgctgaggaggaaccctggacgccactatttcacatggaagaggcaggcgacatgagagtgctggagaggaaccccggacgccaccatttcacatgaagaggcaggcgacatgcgagtgctggagaggaaccatggacgccaccatttcacatggaagaggcaggcgacatgcgagtgctgaggaggaaccctggacgccaccatttcacatgaagaggcaggcgacatgggagtgctgaggaggaaccctggacgccaccatttcacatgaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggacgccactatttcacatgaagaggcaggcgacatgcgagtgctgaggaggaaccctggacgccaccatttcacatggaagaggcaggcgacatgcgagtgttgtggaggaaccctggacgccaccatttcacatgaagaggcaggcgacatgcgagtgctgaggaggagccccggaccgcaccatttcacatgaagaggcaggcgacatgcgagtgctgaagaggaactccggacgccaccatttcacatggaagaggcaggcgacatgcgagtgctggagaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgcgagtgctggagaggaaccccggatgccaccatttcacatggaagaggcagtcgacatgcgagtgctggagaggaaccccggacaccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggaagccaccatttcacatggaagaggcaggcgacatgcgagtgctgaggaggaaccctggacgccaccatttcacatggaagaggcaggcgacatacgagtgctgtggaggaaccgcggacgccaccatttcacatgaagaggcaggcgacatgcgagtgctgaggaggaatcctggacgccaagatttcacatggaagaggcaggcgacatgcgagtgctggagaggaacccgggatgccaccatttcacatgaagaggcaggagacatgcgagtgctgaggaggaaccctggacgccaccatttcacatggaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctgaggaggaaccctggacgccactatttcacatggaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgggagtgctggagaggaaccccagacgccaccatttcacatgaagaggcaggcgacatgcgagtgccgtggaggaaccccggacaccaccatttcacatgaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcaagtgctggagaggaaccccggacgccaccattacacatggaagaggcaggcgacatgcgagtgctggagaggaaccccggacgccactatttcacatggaagaggcaggcgacatgcgagtgctgaggaggaaccctggacgccaccatttcacatggaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccccggacgccaccatttcacatgaagaggcaggcgacatgcgagtgctggagaggaaccccggacgccaccatttcacatggaagaggcaggcgacatgcgagtgctggagaggaaccccggatgccaccatttcacatgaagaggcaggcgacatgggagtgctggagaggaaccccagacgccaccatttcacatgaagaggcaggcgacatgcgagtgctgaggaggaaccccggacgccaccatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggacgccactatttcacatggaagaggcaggcgacatacgagtgctgaggaggaacccttgacgccactatttcacatggaagaggcaggcgacatgcgagtgctggagaggaaccatggacgccaccatttcacatggaagaggcaggcgacatgcgagtgctggagaggaaccccggacgccaccatttcacatgaagaggcaggcgacatgcgagtgctgaggaggaaccctggacgccaccatttcacaagaagaggcaggcgacatgcgagtgctgtggaggaaccccggacaccaccatttcacatgaagaggcaggcgacatacgagtgctgaggaggaaccccggacgccaccatttcacatgaagaggcaggcgacatgcgagtgctggagaggaaccccggacgccaccatttcacatggaagaggcaggcgacatgcgagtgctagagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgactgctggagaggaaccccggacgccactatttcacatggaagaggcaggcgacatgcgagtgctgaggaggaaccctggacgccaccatttcacatggaagaggcaggcgacatgcgagtgctggagaggaaccctggacgcaaccatttcacatggaagaggcaggcgacatacgagtgctgaggaggaaccctggacgccactatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgagagtgctgaggaggaaccccggacgccaccatttcacatgaagaggcaggcgacatgcgagcgctggagaggaaccccggacgccactatttcacatggaagaggcaggcgacatgcgagtgctggagaggaaccccggacgccaccatttcacatgaagaggcaggcgacatgcaagtgctggagaggaaccccagatgccaccatttcacatgaagaggcaggcgacatgcgagtgctgaggaggaaccctggacgccaccatttcacatggaagaggcaggagacatgggagtgctgaggaggaaccctggacgccaccatttcacatgaagaggcaggcgacatgcgagtgctgaggaggaaccctggatgccaccatttcacatggaagaggcaggcgacatgcgagtgctgtggaggaaccccagacgccaccatttcacatgaagaggcaggcgacatgcgagtgctggagaggaaccccggacgccaccatttcacatggaagaggcaggcgacatgcgagtgctgaggaggaaccccggacaccaccatttcacatgaagaggcaggcgacgtgcgagtgctgaggaggaaccctggatgccaccatttcacatggaagaggcaggcgacatgcgagtgctgtggaggaaccccggacgccaccatttcacatgaagaggcaggcgacatgcgagtgctggagaggaaccccggacgccaccatttcacatggaagaggcaggcgacatgcgagtgccgaggaggaaccccggacaccaccatttcacatgaagaggcaggcgacatgcgagtgctggagaggaaccccggacaccaccatttcacatggaagaggcaggcgacatgcgagtgctggagaggaaccccggacgccaccatttcacatggaagagggaggtgacatgcgagtgctggagaggaaccccggacgccaccatttcacatggaagaggcaggcgacatgcgagtgctgaggaggaacccttgacgccactatttcacatggaagaggcaggcgacatgcgagtgctggagaggaaccccggacgccaccatttcacatgaagaggcaggcgacatgcgagtgctgaggaggaaccctggacgccactatttcacatggaagagtcaggcgacatgcgagtgctgaggaggaaccctggacgccaccatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccctgggcgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagacgaaccccggacgccaccatttcacatgaagagggaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcaagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccctggacgccaccatttcacatgaagaggcaggcgacatgcgagtgctgaggaggaaccctggatgccaccatttcacatgaagaggcaggcgacatgcgagtgctggagaggaaccccggacgccaccatttcacatgaagaggcaggcgacatgcgagtgctgaggaggaaccccggactccaccatttcacatggaagaggcaggcgacatgcgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccctggaccccaccatttcacatggaagaggcaggcgacatgcgagtgctggagaggaaccccggacgccaccatttcacatggaagatgcaggcgacatgcgagtgctgaggaggaacgcttgacgccactatttcacatggaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacatgggagtgctggagaggaaccccagacgccaccatttcacatgaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccccgggcgccaccatttcacatggaagaggcaggcgacatgcgagtgctggagaggaaccccggatgccaccatttcacatggaagaggcaggcgacatgcgagtgctggagaggaaccccggacaccaccatttcacatgaagaggcaggcgacatgcgagtgctgaggaggaaccccggacgccaccatttcacatggaagaggcaggcgacatgcaagtgctggagaggaaccccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatgcgagtgctggagaggaaccctggacgccaccatttcacatggaagaggcaggagacatacgagtgctgaggaggaaccctggacgccactatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgagagtgctgaggaggaaccccggacgccaccatttcacatgaagaggcaggcgacatgcgagtgctggagaggaaccccggacgccactatttcacatggaagaggcaggcgacatgcgagtgctggagaggaaccccggacgccaccatttcacatgaagaggcaggcgacatgcaagtgctggagaggaaccccagacgccaccatttcacatgaagaggcaggcgacatgcgagtgctgaggaggaaccctggacgccaccatttcacatggaagaggcaggagacatgggagtgctgaggaggaaccctggacgccaccatttcacatgaagaggcaggcgacatgcgagtgctgaggaggaaccctggatgccaccatttcacatggaagaggcaggcgacatgcgagtgctgtggaggaaccgcggacgccaccatttcacatgaagaggcaggcgacatgcgagtgctggagaggaaccccggacgccaccatttcacatggaagaggcaggcgacatgcgagtgctgaggaggaaccccggacaccaccatttcacatgaagaggcaggcgacatgcgagtgctgaggaggaaccccggatgccaccatttcacatggaagaggcaggcgacatgcgagtgctgaggaggaaccccggacaccaccatttcacatgaagaggcaggcgacatgcgagtgctggagaggaaccccggacaccaccatttcacatgaagaggcaggcgacatgcgagtgctgaggaggaaccctggacgccaccatttcacctggaagaggcaggcgacatgcgagtgctggagaggaaccccggacgccaccatttcacatcgaagaggcaggcgacatgtgagtgctggagaggaaccccggacgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacatgcgagtgctggagaggaaccccggacgccaccatttcacatgaagaggcaggcgacatgcgagtgctgaggaggaatcctggacgccaacatttcacatggaagaggcaggcgacatgcgagtgctggagaggaacccgggatgccaccatttcacatgaagaggcaggcgacatgcgagtgctgaggaggaaccctggacgccaccatttcacatggaagaggcaggcgacatgtgagtgctgaggaggaaccccggacgccaccatttcacatgaagaggcaggcgacatgcgagtgccggagaggaaccccggacgccaccatttcacatggaagaggcaggcgacatgcgagtgctggagaggaaccccggacgccaccatttcacatggaagaggcaggcgacatgcgagtgctgaggaggaaccctggacgccactatttcacatggaagaggcaggcgacatgcgagtgctgaggaggaaccccggatgccaccatttcacatgaagaggcaggcgacatgcgagtgctggagaggaaccccggacgccaccatttcacatggaagaggcaggcgacatgcgagtgctggagaggaaccccggacgccaccatttcacatgaagaggcaggcgacatgggagtgctggagaggaaccccagacgccaccatttcacatgaagaggcaggcgacatgcgagtgctgaggaggaaccccggacgccaccatttcacatggaagaggcaggcgacatgcgagtgctggagaggaaccccggacgccaccatttcacatgaagaggcaggcgacatgcgagtgctgaggaggaaccctggacgccaccatttcacatgaagaggcaggcgacatgcgagtgctggagaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacatgcgagtgctgaggaggaaccctggacgccaccatttcacatgaagaggcaggcgacatgcgagtgctgaggaggaaccctggacgccaccatttcacatgaagaggcaggcgacatgcgagtgctgaggaggaaccctggacaccaccatttcacatggaagaggcaggcgacatgcgagtgttgtggaggaaccccggacgccaccatttcacatgaagaggcaggcgacatgcgagtgctgaggaggaaccccggacgccaccatttcacatgaagaggcaggcgacatgcgagtgctggagaggaaccccagacgccaccatttcacatggaagagggaggtgacatgcgagtgctggagaggaaccccggacgccaccatttcacatggaagaggcaggcgacatgcgagtgctgaggaggaaccctggacgccaccatttcacatggaagaggcaggcgacatgcgagtgctggagaggaaccccggacaccaccatttcacatgaagaggcaggcgacatgcgagtgctgaggaggaaccccggacgccaccatttcacatggaagaggcaggcaacatgcgagtgctggagaggaacccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatacgagtgctgtggaggaaccccggacgccaccatttcacatgaagaggcaggcgacatgcgagtgctgaggaggaaccctggacgccaccatttcacatggaagaggcaggcgacatgcgagtgctggagtggaaccccggacgccaccatttcacatggaagaggcaggcgacatgcgagtgctgaggaggaacccttgacgccactatttcacatggaagaggcaggcgacatgcgagtgctggagaggaaccctggacgccaccatttcacatgaagaggcaggcgacatgcgagtgctgaggaggaaccccggacgccaccatttcacatgaagaggcaggcgacatgcgagtgctggagaggaaccccagacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgagtgctgaggaggaaccctggacgccaccatttcacatggaagaggcaggcgacatgcgagtgctgaggaggaaccctggacgccaccatttcacatggaagaggcaggcgacatgcgagtgttgtggaggaaccccggacgccaccatttcacatgaagaggcaggcgacatgcgagtggtgaggaggaaccccggaccgcaccatttcacatgaagtggcaggcgacatgcgagtgctgaagaggaaccccggacgccaccatttcacatggaagagggaggcgacatgcgagtgctggagaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatggaagaggcaggcgacatgcgagtgttggagaggaaccccggacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgattgctgaggaggaaccctggatgccaccatttcacatggaagtggcaggtgacatgcgagtgctggagaggaaccctggacgccaccatttcacatggaagaggcaggcgacatgcgagtgctggagaggaaccctggacgccaccatttcacatggaagaggcaggcgacatgcaagtgctgaggaggaacccttgacgccactatttcacatggaagaggcaggcgacatgcgagtgctggagaggaaccccggacgccaccatttcacatgaagaggcaggcgacatgcgagtgctggagaggaaccccggacgccaccatttcacatgaagaggcaggcgacatgcgagtgctgaggaggaaccctgggcgccaccatttcacatggaagaggcaggcgacatgcgagtgctggagaggaaccccggacgccaccatttcacatgaagaggcaggcgacatgcgagtgctgaggaggaaccccggacgccaccatttcacatggaagaggcaggcgacatgggagtgctggagaggaaccccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatacgagtgctgtggaggaaccctggacgccaccatttcacatgaagaggcaggcaacatgcgagtgctgaggaggaaccctggacgccaccatttctcatggaagaggcaggcgacatgcgagtgctggagaggaaccccggacgccaccatttcacatggaagaggcaggcgacatgcgagtgctgaggaggaacccttgacgccactatttcacatggaagaggcaggcgacatgcgagtgctggagaggaaccccggacgccaccatttcacatgaagaggcaggcgacatgcgagtgctgaggaggaaccccggacgccaccatttcacatggaagaggcaggcgacatgcgagtgttgtggaggaaccctggacgccaccatttcacatgaagaggcaggcgacatgcgagtgctgaggaggagccccggaccgcaccatttcacatgaagaggcaggcgacatgcgagtgctgaagaggaactccggacgccaccatttcacatggaagaggcaggcgacatgcgagtgctggagaggaaccccggacgccaccatttcacatgaagaggcaggcgacatgcgagtgctgaggaggaaccctggacgccaccatttcacatggaagaggcaggcgacgtgcgagtgctgaggaggaaccctggacgccaccatttcacatgaagaggcaggcgacatgcgattgctgaggaggaaccctggatgccaccatttcacatggaagtggcaggtgacatgcgagtgctggagaggaaccctggacgccaccatttcacatggaagaggcaggcgacatgcgagtgctgtagaggaaccccggacgccaccatttcacatgaagaggcaggcgacatgcgtgtgctgaggaggaaccctggacgccaccatttcacatggaagaggcaggcgacatgcgagtgctgtggaggaaccccggacgccaccatttcacatgggaaggccggcttcctctttgctaatgaatgagataattacaacagaatcaagccaaccccagaaagcgcagcgcctgagcagaagaaatgggaagttcactgggtggcagtgttgggaactgaggtagaaatagagcattccaggtttgcaataatacaggttatttccttacgtcatttccgtatatcctaaaaagaggagcaggagggcacatactaggtctaagcttccatctctactcctaaaggaatactactagctgaggtagtccatactcccagcagaatttgagctcataggaagagagaaaaaaatatatctgaggaggagtactagccctttaaaagaaaaatagatactgaagaatcttatcagagagagctgaattaatggtccagataaaacaagaactggaaataaaataaatatcttcagagagcaggaaaggatattgcaaatatgaagcaggaacaatcagtgaagacaaagaatcaaatgaggatgggaataaaacatataatagcaaaatgtatatagacaaagaataaatcagtaagataaagaatctggttggaaaattttccccaagtttaaataaaggcataaaagatggaaaatatctaagaactaaaataaagagaaactaaaagtggaaaggtcaattttgatttactacataaaactaaatagagtatagaattgttttcattgttgttgagatataattgagaattaaagaaagatagaaagtcagatcaaaatggctccataaaacaacagaccacattgataagcaaaacctcaaatcttgacacattacacttaatttaaaataacaaaggcaaaattctaaaagcatctgaataagaaataatatttcattgtaaattaagataattagcatcaaatttttgaatggtaacactagaatattaaagtgacatttgaaaaatattgaagaaaaataaacttagacctagagttttatatacagataaactattatttaaacactaggttgaataaaataaaggcatttcaagagacacatagaaggcgagggcacataaaatcttacagaaaacattctacagggagtacttctacagagaaaacaaataattccaaaaagaaagtttaaggtcaaccaaataagcaatggcaaaaaagaaatattgtgtgtgattatttgtatatgtgtataagagtgtcgtccaatgggcctttctgttttgatggagatattctatttgtactgttcaatatgatagaccatagccatgtgtggctgttggatgaaaagtatggctagtgtggccaaggaactgagttttaaattttatttaaccttaataaatttaaatttgaatagccatgtgtggttagtggctactacattgtacagcagagccctgtactaacacagatgaaatgttccagattataccaatatatgctgagggtcaggaacatgcagaaatcagaggatttggacagtatgttcaggttcttgtcttttacacagggaagaaataataatgagctctaaaaaattaagtctgaaatttaaggtattagcagaaaccaactgaaagatagacgttaaaatttggctttcaaaacagaagaaaaaaaattgctctcttcaataaaatgcaagaatggagaaaaaataaacaagaagaaaggttgatacatagaaaatatgcaataggatgacaagaataaatcatagtatgacagtaatttaagtaaatgtaaataggttaaacatgcacatcaaatcacagagactctcaggaaataagatgctgtaatacattgtctattagagatatttgaaacaaaagaaaacagctagttgaaaatacatgagacatccatttttattatcaattttaataacaaagaaattataagttgttaaactatgtaagtaaaagatatgaataccatatatgtgtatatatacacatacatatgaagaaaggagatgctgggcgcagtggctcatgcctgtaatcccaacactttgggagaacaagatgggcagatcacgaggtcaggagatggagaacatcctggctaacacagtgaaaccccatctctactaaaaaatacaaaaagttagccaggcgtgttagcgggcgcctgtagtcccagctactcaggaggttgaggcaggagaatggcgtgaacccaggaggcggagcttgcagagatagcgccactgcactccagcctgggcgacagagcaagactccgtctcaaaacaaacaaacaaacaaacgaacaaaaacaagaaagaggaaataaaaaagaaaatgaaatgtatacatccacctctatgatgaagacagatacattctgagaaaaaggtgcataaatcaacaattgcagttggagttttggacacactttcaagaagaaaaactgatccaaaagacaaaaaataaaaagaggaaggatttagacggtttgaaaaaaactctctgattgataagctcaaacccataaatgcatatagattttcacactccaaaacctagaatacacctgcacatagtaaatatttataaagcctcaaattttatgaaatcaaaagcataaaacatcagagatcaataaacaaaaagttacttttaaaggatctgcaggtgaccttgaataacacagggatcaatgtatgatcaaagtatatcatgaacaacagaatggctaaaaattggagaacttagataaaattgatgaatttctggagttatatataataccaaaattgttacaggattaagcaaaaaccttgaatgagacaatcatcagggaaataattaaaagttaatcaaagacttctcccctaaaacagcttcaacaccagatggttttaaatgtgagttctacctaactttagaggaacagataatcttgatcttatacaagagaactcttccaaatgcaattaaatctaataatgtgtgaaaattcgtaataacgaatatattttttccaaggaatataatggtattttaataacagatattctattaaagtaacaatcatactcattgggaaagctgtaattacttagtttagtttagtttacttatgggccaagtaaataacaacaaaaatctggccacatctccattaaggccttggaatcatcaatccacataattaaaatggaaaagttgtgtcatgagtcacgacagatactacaaattcactcacttaaaaatgggaaaaggaaagaaagatgtaccctattactacaaatgcttaacataacattggaggtatttgttaatgcaagatagtaagaaaaaaataagatgcctaaggatcagaagggtcgcaaaaacagtcttatttatttacatgtaataggaccctctaaatagaaaaccaagtaaaatcaaaagaaaatttagtaatgataaaactgaggaaagttgtttaatacaggacagacatctaaaatcaataccattggtttattatattttcaaagttgaaaatataatttatgttttatataaatatataattgtgaataatgtcttaattttcaactttgaaaatataataaaaataagacattattcttagtgacaacatttctaaaatttctcaggaattattgtaacaaataatccaatcattcctacaatttagagattggaaaagggactagggtaaatctagttagtagattttcaaagaattattttagcaaaatttaactgagcttagaacttacaataatattttcctaaaccaattttcaacaataattctagatttttctcagtgtatccaagttatagtcagttaacatatgagttacttagagtacagcccaagtttaactttcataataacacctaattagtgccaaatcgcacagataatgtggtaggcagcctctgaaatggtttcccactgaaccctcctcgctgtatttactacttcccgaaatcctctccttttgaccatgggctggacctagtgcctaatgcatagaatatgacaaaggggataagatgtcatttccaagatgaggttacaaagagtttgtgctttccatcttgctgtcattctctcttacccacttgctagcttccttggtggcaattcaatggccttgctatgagctgtgctgtggagagacccacatggcaaggaaatgaaggaggccagtagccagtgggcaactgaatcctgcaaccatgtaagtgagtttgaaaacatcttccccaagtcaagtcttcagaggagactgcagcccctgctgacaccttgattatagccttggcagaggctttaggcagacactcagctaagccacgatctggattcctgactcacggagataatgcttactcttttgagcttctaacttttgatgtaatttgttatatagcaatagataactaatataggcaagtatctgaaataaagtagacaactagctaaagaggaatgttggtgattatgtgcctcaaaatgagaactatgattaacgtagcttacttatgggccaagtaaataacgacaaatacaagccaaaaatctggccacatttccattaagaccttggtatcatcaatccacataatcaaaatggaaaaagttgtgtcatgaggcatgacagatacttcagattcactcacttaaaactcattttagctcattcatccttgttttcctgtacatggttctggaaagcaaatgcttgaatttccagtctgcctttcagctaactgtgatcatggacacaggtctggattagaaaatgaaagcagaagttcccaaggagagtttcattttcatattaaaaatgaattctccagaaaaggcattttactttcaccccctgcacattctttctgcttgcaatgtgaaagtgatatttagaaatgcaggacatcttgcagtcatgagcacagaggggaaagctgtctgctaagaatggcaccatgggaagctgggagcatcctgcgctcctggtggcattgtgcggtgaaggactagtctacactcttgttagtgttggggatttctgctgttcacagctgagtatttcctaactgaaaccagtagaataattttgatttttgtatctaaactttgtgggagagcataaattccatcagattacctcagttaataatgagtaaaatgggcagggcgcggtggctcacgcctgtaatcccagcactctgggaggcagaggcaggcagatcacttgagatcaggagttcgagaccagcctgaccaacatagcgaaaccccatcgctgctaaaaatacaaaattagctgggcgtggtggcgcatacctgcaatcccagctactaggatggctgaggcaggagaatcgcttgaacgtgggaggcagaggttgcagtgagccgagatggcaccattgcactccagcctgggcaacaagagcgaaagtccgtctcaaaaaaaaaaaaaaaaaaaaggtaaaatgaagagaatttcaagaaggtccatttcaggcactatttttgttttagcagaaatttaatgaaataaaaaagtgatgagaaattaatcaagagtattcaagacctaagttttcctttggtgttggtttacttgtggaagatcccgtgaatctggactgaattatacctgattccagtaagtttcaaactcaacccagctcaatccaggcatgtaatatctcaaaagggctctcttttattagtgtttaaggtcaaggatttttccagggttattaagtggaatttctgtgacaacttgaaatctggtattagaatgggactgatctatgcagtacggtgagtccagctgtattttacttcttacacttggtttctgagaaatttaagtacgttttaaatttagggcaccattcagcatcatctaggaaataccacactaatggtgtgagagtttactaaattttcctcttttactcagggtacttggtagctagcaatagaaaccaactttggctggtttaatcataaatagattttattgaaaggattttgggtaatttacagaattgccagaagagctgaagaatcagacatggaaaataggcaggctctataggaggcaatgcatggtgaccacagccaaacttccatcggggacagtctggcggggtctttcttgtgtcctggaatgatgacggccagtgcaggtcctgaagaatgcagctgccgtggacccagtcagcacctctggtcaactgccctggaatgagaaagcatcctcactgcctctagaatgcaattctcctctaaccctacttctttgctgaattgctccacattcaaagatgtgggcatcagtgtctgcctgaatctagtaatgaaattaaagtttaaagcaatgagaggtagacaaaactgggtacttattacgttccaaatactttccaatttattcccatatctctggaatacatgttttttaaaaggggtgatgtaagaatggggaaagcaaaataattaagaaaaaattatgaaaataactggttgatggaataattgaacggaataaatggaataatgaaaggatgtcaaagaccttcgtgcattacgtgtatatagctctgaagtgtgtgtatataactctgatggatgtgttgagatttggctctgagtgagggactcttgcaggaaaaagaaataaacatgcacgttaacttgctcttctaccctgtcttaggcaattcatccagatgaatttttaactatcccgtagtgatggggcatccaggccgtattttttaaaatgtgcaattagagtaaacaatttagaatcctgtgctcaccttacactaataactttgcatcaaaatttatgcagtttagtgtgtttggcaaatgacttgtgcctttagtttcacttcctcgcggcattttcccttccgtttggttaattatgatttacttctgttagtttccaagaccccatttcaccgagttcacatggtgttgtgagtaataacttgactgttgtaattgtcttccgggattaatcctgtttgtgttggagggttacaagcattctcaccagaggggatgctttggaagttttgcattattcatgtgtaaggcaaattcacgaatgttaagagttggaaaacaatgaaaaccaaaaatttggtctaaaatcctttttggagaactgaggaagacagatggtctggaagatttttagtgtcagatctgaactctaatcagtcaaggagagaaactttcagaactgggtggtcaaaatggcatcctaggaattttgacttgcagtcttaaagaagacagcctaaaagaaaaggaaaaaacgttctcaccctagagcatttttatgcaaaacgatgaaatttataggaaaattggaaacagtcaatttctgagaattatatacagacggtgaactaactgtggcataatcattatttgtgttgatactattaaacgttttgggggaatctggtttacttgattaaaaccaggattctttcttttccccaatgagcagattatttcctgcggatatatgttcctgcagtcttcgttcattgcactgataacaagtgtaatttctttattgtctgtttctctagtttgtaagtttcagacaggggagttaggtctaccttcttcttcttgttcccctcttccagcacatatgtacgtggcacatagtaaatctttcattatttgttgatcagttgcctaacaggagcatggaagtaaatgaattatatttggaacatttcatcctgaagatacccacccagaggagaaggcagggtaaaattctagtcagctcagtcttagttcttgactcttcaaaactcttgttagttttgactcagttccaagattctgcatctggtttgtgattgtcctctgcaaatccttggaaaggaccaatcctcgtgtagaatagactttccataaatatttattatgtggattttgctcattgttgactgatctgggggtcttggctgcaatcttttcaaaagagtttggtgtgaatctagttgactggaatctggggttaccctgggcagacgttaagcctataattggttttaacagaaatatatatagcatatatatggcatatatatgtatatatagctatatatatatatatagcatatatatggcatgtatatagtatatatatatagcatatatatggcatatatgtgtgtgtatatatatatatagctatatatacatatatatgtatatatagcatatatatgtatatatagctatatatacatatatgtgtatatatagcatatatatgtatatatagctatatatgtgtatatacagcatatatatgtatatatacgtatatatacagctatatatatatatagctggcatccctagacgtggcacagtctgtctgaaactagagcaaagttccctcctctggctaccctaggatgacatagtctttcaaagtaggaatatgacagtattatataaatataacatatttattagcagtaaggactgtaacttttctatattgcctacaaagttcaattgagtgattattcccacggatctagagatatttttaaggtattatataacaatattgttattagctctgactatgccattatttttctagcttctaggcttctgtgtttactgttttgtctgaaatatttttctcctcttcacctcaactcttccccatccccacccccataaaaaaaccctgagttacattcgtctgctctaggttcccatcctataaaccaccatttacttcctcgtcattatgttttgcacacacgtattgctgcctgtctgatttcctgcctcccttcctaggccatgcataaactgtgtgagggcgtgtactacacctgtcctttgttccgagtactggtgccatttctgccatatagttgacaacatctctttattggatgaaaaatgaatgagtgcgtgaacatgtggcctaaacagagaatgtttccgtgtgaagtttctgtaccagccaactatcttcttaacagcttggtagagttgggaaaggggcaataggagaaatgctgtccctgtttcagcttctgggccagaccctacgactgaccccatttctgcaatggccccatcacccgtgctgtgggtttgtgtcatatacacaagccttgtgaaaataccacagaccactgtgaggccattcaacaaagaacagatggatttcaccttgagtgttgttttccaaagcacacgtgtttcggtgccaccacgtttcccttgcccatcatgtgagcctcctccctccatcgtgctcctctttctgcttccatcacatcaggggccctgaaggcgacagcactgattccgtcctctttgcctgcccagcacctggtcacagatttggatggaggacaaataaagcataatagtgttctaagagcctttcccctagcttggcagtcagcttctgacaaggtcatcaggtagggtggggaggagggtgcaggggcaaaggagaagctcaccccttgcctttggagggtttgttgaaaaaaaacatcaactcgcagtaaggcaaattaagaagaggaaaggcatacaaattcattcaccatgtgcttggggagaatcacagagtgattccctaatttcccaatggggcccacacacttacataaactcctttcagaggaaggggagagagagaatataggtaattctgttgaggggcattaaatgacgaccaaggaaacatgagtgggtacttgagagaaggaacggcagaggggaagaggcagagactgatttgtaaatggttgtctttggaagttcagtgaatctgagagatgggcattatcttgtaaaaagattgggtgagatctggttacattcttccgctcctttcctgaaatagatcatgagataacaggggaaaaggaaatattcttgaaagagaaaatgagataacaaggaaaaagcaattcttcttctggtgggtccctctggtcttcatgaagctagggaaaagtgtcttccaaggcctgttgttttctaagggttttaattaaaaatattcattatcccagggagccgtattttggggtgaaaaatctctttcctgagggggcatactctgcaagagggtggttgagtctcctgatggcatcgttctcagaatttgggattgtatgctcagaacctttgatgcatgttttgtaggttgtataaaaccacacatctgtcctttccagaccgaaatatcgagttctccacaatgatcctctgtgacacaagttacatttgcaatagaaacctatcttgtatatgagaaatgcaatccagtattgattcgacacatctgggttgaattcctgacttgtccacagccagcgatatgcccttggacaagctactttatcccattgagactctgttctcacctctacgaggagagtgtcagaggcatttggaccagagcgactccatcttgaataggggctgggtaaaatgatgctgagacctagtgggctgcattcccaggagttaaggcgttcttagtcacaagatgagacataggtcagcataaaatacaggtcataaagaccttgctgataaaacaggttacagtaaagaagccagccaatacccaccaaaaccaagatggtgaaagagtgacatctggtcctcttcactgctcattatacgctgattataaggcattagcatgctaagagacactcctgccagtgccatggcagtttacaaatgccatggcaaccaacgtcaggaagctaccctatgtggtctaaaaaccggtctaaaaagggcaggagccctctgttctggggcaattgcccagccctttcccggaaaactcatgaataatccacccctcatttagcatatcatcaagaaatcgccataaaaatgcgtagccagcagtcctcagggctgccctgcttagggagtagccattcttttattccttgacctccttaaactttctttcactttatggactggccctgaagttataataaaatcactgtttcttttcacaactggaagttgagataaacccgtaagaccacattttagttcccaggctagcatcttgagccctgtgagtctgagttctatttttccctccagtcttaacttttattgtattatggcaattatgaattatgaatattttgataacataatgcatgaatgcacgctcttgatacatacttcaaacggtaaggaattttgtaaagttaaatggaagagttcttcactcaatatccttggcccaacagacgtgcctatgaactctgtggcttttcctccctcgtcctgtttcacctccgctcctgctgttgcctccctcctcctccctggctcctaagtctttgagtaactcagcggccttttggtgattgttccatttaggggtagattcctcagagaggccttgtccacccaacgggaggaagtctgcctgaccttactccacggtattttaaaccagagtatgctgtttgcatccttactaaaactatgcaggatcatgactggccagggcggcttgcacctataatcccagcactttgggaggctgaggcaggaggctcacttgaggccaggagtttgagaccagcctgggaaacacagtgagaccccatctctaaaaaaagaaagaagaaaaagaactctgttgtaattctgtttgtttgctttgcttctttccactgtctgccttacattcttgccttctgcattgtaagcataagaaggcggagtgcaggatatgcttgttctatatactgttgtggtcctacttttcctcatattgcctgaagtaaatgttggtggaaaaattaatacacacacatacacagatgcatatacaaatacattttactcagtgccccgtgttatatatataactttgttttgaacatagtaaatcttagagatcttcctatattgggacattcagtgactgactagtattgcactgtgtggaaataccaataatttattaaatcttctcattgcaaatggacaaattaggttgtttccaattttttataatcataaagaatgaatcattgaccatctcagtcttgcccagaccttatctggccacccatgcaggtatttttgtaagataaattcctataagaggaatgattgagttgaagggatgacacaattttgattttgagagataatctcgaattaactttaaaagttgatgtaccaaattacatgtgagccagctgcaattgtaagagttcttgttttgtaattctcaatatcagcagatattataaatcttcaagttttgtcaagttaaagggtaaaaatcctagctatatctcattgttctaatttgcatttatgattactaacaaagttaaatattttaatgtgtttatagtcgtgtacttttcctatgaattgcctttccttgtacattaccttttttcattcattttttcttaatgattgcagaagctttaaccttttgatgtttattatttgtcgttatgtgcattccaaagaatttctgctgatctgttgtttatgattaacatttttgaatggtattctttcaaatgtaactaattttttaagagctttattgagatgtaattgatatatgaagaactgcactgtacttgaactcctgagctcaagtgatcccctgccttggcagctcgggtagctaggaatacatgtgcacactatgtcacccaggtcatttttaaattttttgtacagatgggttcttcctgtgttgccaggctggtcttgaactcctggcctcaagcaatactcctgtctcagactcccaacactatgggattacaggtgtgagccagtgcacctggatcaactatgcatgtttaatgtatacaatttgataaatttgggcatatgaaaacacctgtgatattatcagcataatcaaagaaatagacactgtattagttcattttcacactgctgataaagacatacccgagtctgggcaatttacaaaagaaagaggtttaatggacttacagttccacagggctggggatgcctcacaatcatggtggaaggcaaggaggagcaagtcacatcttacatagatggtggcaggcaaagagggagagcttatgtagggaaactcccccttataaaaccatcagatctcctgagacttattcactaccacaagaacagcatgggaaagacatgcccccatgattcagttacctccctctgggtccctcccagaacacgtaggaatccaagatgagatttgggtggggacatagccaaaccatgtaattccacccaagctcctcccaaatctcatgtcctcacatttcaaagccaatcattccttcccaacagttccccaaagtcataactcatttcagcattaactcaaaagtccacagtccaaagtctcatttgagacaaggcaagtcccttctgtctatgagcctgtaacatcaaaagcaagttagttacttcctagatacaatgtgggtacaggcattgggtaaatacagccattccaaatgggaaacattggccaaaacaaaggagctacaggccccatacaagtccgaaatccagtggggcagtcaaatcctaaagatccaaaatgagctcctttgacccatgtctcacattcaggtcacgctgatgcaagaggtgcattccctggccttgggcagctccacccctgtggttttgctggatatagcccctctcctgactgctttcacaggctggtattgtctgtggcttttccaggggcacagtgcaagctgttggtggatctaccattcttgggtctggagaacagtggcccttgtttcttttcttttcttttcttttcttttcttttcttttcttttcttttcttttcttttcttttcttttcctttcctttccttttcttctctctctccttctctctctctctctctctctctctctctctctctctctctctctccctctcccttcccttcccttcctttcccttcctttcctttcctttcattttttttgacatggagtttcactcttgtcatccaggctggagtacagtagtgtgattttggctcactgcaacctctgcctcctgggttcaagagattctcctgcctcagcttcctgagtagctgggattacaggtgcctgccaccatgcttggctaattttttgtatttttagtagatacagggttttgccatgttgggcaggttggtctcgaacttctgaccacaggtgatctgcctgccttggccttccaaagtgctgtgattacaggtgtgagccactgcacctggctgaacagtggcccttttttcacagctccattaggcagtactccagtagggactctgtgggggcttcaaccccacatttcccttcttcactgccctagcagaggttctccatgaggaccccacccctgcagcaaacttctgcctggacattcaggcatttccatacattttctgaaatctagacagaggttcccaaacctcaatcctcgacttctgtgaacttgcaggctcaacaccacatggaagctgccaaggcttggggtttacatcctctgaagcaacagcttgggctgtaccttggctctttttagtcacagctggagtggctggaatgcagggcaccaagtccatagactgcacacagcagagggaccccggccctggcccatgaaaccatttttttcctcctaaacctctggtcctgtgatgggaggggctgcttcaaaggtctctaacatgcccggaagacattttccccatggtcttgggaattaacattaggttcctagttacttatgtaaatttctgcagccagcttgaatttctcctcagaaaatgggattttcttttctattgcattgtcaggctgcaaattttccaaacttttatgcccctttccccttttaaaactgaatgcttataacagcacacaagtcacctcttaaatgctttgctgcttggaaatttcttctaccagataccctaaatcatctctctcaagttcaaagttccacaaatctctagggcaggggcaaattgctgccagtctctttgctaaaatataacaagagttacctttgctccagttcccaacaagttcctcatctccatctgagaccacctcagcctggatttcattgtctgtatcattatcagccttctagtcaaagccattcaacaagtctctagggagttccaaactgtctcacagtttcctgtcttcttctgagccctccaaggtgttctaacatctgcctgttacccagttgcaaagtcgcttccacattgttgtctatcgttgcagtagcaccccactctactggtaccagtttactgcattagtctgttttcacgcggctgataaagacatacctgagactggtcaatttacaaaagacagaggtttaacggacttatagttacacagggctggggaggcctcacaatcatagcagaaggcaaggaagagtaagtcacatcttatgtggatggcgagaggcaaagaaagagcttgtgcagggaaactcccccttataaaaccatcagcacttgtgagacttattcattacgctgagaacagcttgggaaagacctgccctcatgtttcaattaccttccactgggtctctcccacaacacataggaatttgagatgagatttgggtggggacacagccaaaccatatcagacaccaacaccttctaatgttttcttgtgtcctttcccctcattgttgtagtaagaacacttaatgtgagacctcttaacaaattttggaatgcaccacatcatattgctaactataggcaatatgttgtaagatagatctctagaatgtattcaactagcataactaaaactttacaccaattgaacaacaactccacatttcccctactcctgagtttctgggaatgactattgtattctttgattctataattttgagtatttcacatccctcatataagtagaatcatgcaatatttgtccttctgtaactggcttattttatttaacattatgtcttttgggtacatccatgttttcacacatagcaagattttgttgttttcgaaggttgagtaatattcaattgtattatacaccacattttctttatccattcatctgtcaatggacaatcttttattgaacaatttattagtttttagtggtcaaagaacaagatcatgtcctttatatgatttatatgttttggttgttattttagaagcccttctccatttcagtagtataaatatatgtatttctgacctttttcttcttatactgttagtttttcagtataacattgaacttttaaaacaccttgactttttttctgagtatggtatgaattagggatatttgttacttttttcccatattaacagttattcacctaattatactttattcagttggtctagactttttcctacatatttgccatctttattataatttaaatcagcatatacacttggatttatttttggtctctctacatagggctatgtatctattgtttaattcttagagatttatgtggatatgtggtaggtatatgtcttcactcactgcgcttattttcaacatttttttccattatatttatttgtttttctcttatagatgaacctgagaataatctgtcaagctgctgataaaaattctttatgaagttaaagattgcacagaacttacaaattaaattgggagaattgaatttcctgtaatattgaagtttctcaaccaaaatattgttacccatttctatttttcactttttaaaaaatgtatgaaacaacatttatagcctttttaaatagaacttctactcttctcattaggattatttctcattttgtgtttttttgctgctattttgagttttttttttctctatttcattctaattgatggttagatggttagtagatggttagaaaattatttatttttatatgatgatattgaatctagccactttgaactcttgtgccattttataaaaatttgttttcttaagtatctagaaaaataatgaaatagtgtctgaaaataataaattttgcctctgtttttcaatatttttacttttctcctcattctattcttattagtgatgaaatatatatatatgtattcattgtctctcatacaaaaagtagccttgacaatctgaaaacaaaatagatttgcattaaaattggaacctaaaatgcaaggatactgaaagttaggtcactttaacaccaattggtgcctttaagatagtattaaaaatatacacatggtatttgccaaattttgaatataggagcatattgtgctttgtacatactttaaaatagccacagatggctgggcgaggtggcttttgcttgtaatcccagcacttaaggaggcctaggtgggcagatcacctgaggtcaggagtttgagaccagcctgaccaacgtggtgaaaccccatctctactaaaaatacaaaaattagccgggtgtggtggtgcatgcttgtaatcctagctactcaggaggctgaggcacaagaatcgtttgaacccaggaggtggatgttgcagtgagcctagatagggctgtcagcctgagtgacagagtgagactctgtctcaaacaaacaaataaaaaaagccacaaatgctaataaaataatacattcctaaaagatactgtttaatagtttctcctaaaagatactgtttaataattactcctattattctaagaacattggcattagaatttagaacataattaacagactcttcttccaaaaatgtgtaacaatgagaggtaatagtgaatggcaaatgtacagtgtgaatgagaggcaagagtaccaggacagaccttgtttaaattatgtaatacattttaaaaatccacagagaataaacatgagcttaactaaataaaatgacttctgtttgtttaaattttttggcagataaaaattaagtgatacaatagtcattctgggtggtgtgagatggtggtatcttattgtggttttgatttgcatttctctaatgatcaaagatattgagctttttttcatatgcctgtagctgcatgtatttcttcttttgaaaagtgtctgttcatgtcctttgcccactctttaatgagattgtttgtttttattcttgtaaatttatttaagttccttatagattctggatacaagacctttgacagatgcatagtttgcaaatattttctcccattctttatgtctgtttactctactgatagtttcttttgctgtgcagaagctctttaatttgatgagatcccatttttcaattttttgttttgttgcaattgcttttggagacttcaataacagacgctgccaaggttgtggagaaaagggaacacttatgcattgttaaggggagtgtaaattagttcaaccattgtggaagcagtgtgacaatttctcaaagagctaaaaatagaactgccattcaacccagcaatcccattactgggtatgcacccaaacgaatatacattattctgtcacaaagacacatgcatgcagatgtccattgcagcaccattcacaataacaaagacatggaattggtgtaaatgcccatctatggtagattggatgaagaaaatgtggtacatataccccgtggaatactatgcagtcataaaaaagaacaagatcgtgttctttgcaggaacatggctggagctggaggccattatccttagcaaactaatgcaggaacagaaaaccaaatactgcatgttctcacttataaatgggagctaaatagtaagaacacctgtacaccaagaggggtacaacacacactgggacttacctgagggtcagaattgggaggagggaaaggatcagaaaaaacaactattgggtactgggcttagtacctgggtgatgaaataatctgtacaacaaaccttcatgatatgagtttacctatataacaaacctgaacatatacccctgaacctaaaataaaagttataaataaataaataaaataaaattcaagtgtatgaaacatttattattattattattactattttttaaagaacctgctgggaatgtattgcaagtgcgttgtaactgtagttcacctacttaccttaacaatattgaggttttctgactagtgaacatggtatatctttccatttatctaggttttctttaatttctctcagcaagttttgtagttttcagtgtacaggtattgtacatattttgtttaaccatatgtaatttatactttgtatgctatttccaattttcattaatagcatataaaaatataatagatttttaaatattgaccacatatcttgtggccttgctaaattcatgtattagtccatttttaaaaataaatcctattcttttaatttttttataatttcttataaattctatttttcctgcatagaagatctgtcctctgttatttcatcctttccaaaaaaaaattcagtgatgtgatgttgtccatgttgctctgagggcatcactacgatggaaagcacatcctcccgattttcaacgtggagagatgtcccatgtaacctattccttgtgaaagcaacccaaaagtcctatagacacttgcttttggataaacacaggaatggaaccttctgctgttaaagtttgaaacttatgtttgttttatctgagttccttcctcaggaaactaccttcaggcctctcacaaaaagcatcaaagaactgaacccagatcaccacaccggttgccggacccctcattcaccaggatcgcttccttgctcctcccgagttcctgttttcttattcattcttacatttcttggctgctatataatcccctggttttaatcagtcaggaagatggatttgagactgcagcatctcctcagctgcagcacccaattaaagccttctcccttggcaagactcatcgtctcagtgactggctttctttgcagtgagtgcaggactgagactgaacccttggtgttttggtaacaattgttcaacaatcatttgttgtgaccctcatctttccttctcttttaattttcttgagctcatattttaatttttatttattacatgatattccaatttaattatattgaattaataagttattctgttgatgccctccagaatattatctcatggtatttatatcatttcacttaatgtctcttcatgaattaggactcacagctttggaactgcactgaatggttttgagcttggaccatatatcattcattcatttttgggagttcactttagtgtgcctcagggtgggaataatgcaactttaattcatgatctttaaaggaagccctttggatcgtatattgatgataggatgaaaggatctcaataaagcagaacttgtttgagattaggtcacatttcatttcaaaattattaggttgaagttgctgatttagtgggatattgtatcggttgatgttaaaatgatctcgtgtgttagattttgatagcatggaggaacagagatgggcaatcatatccttctgtatttccttcttgtgacaagatatgaccatggaagcactgatgtactaagggaaatagtgtttcatcaactgcactgagctatccagagtcaggaaatataataaaaaccattaatattccttgctaaagggatttctatttatttaactgctaactcagttattttagtaacataatggttaaatcagtagaggttcttttctgcaaattatatttgcagggagtcagtaagatagattttaccttcttgggaaaatgagtcattggggaaatatctgtaggtcttctttggaagaatattctagagactattgtgatcaagcatctacaaacttgtgatagattttgttgaatcaatttcagtgtgagatctttagagaagagtagaagaactattctgttaggataaagatttaatttgatagagagatcacaaagagccacaatgtcaaaagattcaagatagtttgcacctaacttaaaattggaacagtagtgtaaaatataaaaacactgtgcttaatatgtttcatatgctttctatgttaaatatatatatttaatatgctgaatatataggaggttctataaatagttttcattctcaaatgaaatcttacattgtaagatagaaaaaaagacgtaggcctcatttgcatttgaaaatagaaatgaagaaatgagaaaatgaataattctagtatcagactgtgtttcttctgcaatggataattactttaagaaaaacgaattttcatttgaattggtgaaaaattgataacttttcctcactttttaaaatgtaaatagagtggttggaaactaaaaaaaaaatcagtaagatcagctttctctgcacctgtgtcagcaaaacataaggaattctgaggggaaaaagtgaaacgttacttaacatcatctattaaggaactttttctcttaagttctttaataagttgctgtttagattgcaagaggatgtttaatatccagaagcataaccctgaaatctcaagacttcgacttacaattgcctacaaaaatattctaatttactgattgtaatgttttccatatacaattaagaaacagtttagcacattattattttaattttgcattcttcaatgtaattttacatcacatttattgattatagacttgtgtgtctttctcattatttggcttcacagtagttccctaggatgctttgtctgtaaagccactttaaaatgtcatccacatcacaaatgttacaaatcctattacacagttcacccaagattctgcacacgtttttccagtgtgcaatgtagcaaaaataactgaaatactgtatagtggatggatttggcatggaagtcatcccaaagatctgctggagtataacagggcttcagactggatcaaataggaattctcagtatttcaatagaataaaggtaaattccacacaaggcagtttttcccctccatatatagtaaagatttaatgacagtctctggaaagattgtactggcaatgtttcaagtatcacattgtcttttagggattaattgttcctaaatgtgatacgaacaaatttcctcagagctcctacgtcttctaaagatagctgtaatatgtgctatgcttgactgcaaggatgcaaaatgacttttccatattcaactgtctcttcggcactactcaaattttaacgagtaatggatttttgtgactaaaaaggtagttgtatgttgactggacgacagtaaatgtttccattctaattagagaatagcagaatgggaagtaaccatggaagtaatttgactgattgattggtttttgctttatcaagtatgtgagataatacatacaaagctttgcttaggaactcctaatttcaacatctccatccctgccgcatatcccattccggattctgtttctcatcctctgtcttcccaccccattcctggatttaaactctttgaaatcaattctccctaaacacctctgagattgagtggaaaagcctagaaggcagtagatccttgagattgtggccttgagggtttgagggagacaacacttaccaaacttgaatttccctcaactctggttgggttccttgttggagctgcccttgtgcggaaagccagtggattagagtgcagtgggaatcgcagggaaacgcctctgaaggcttatccatcacagtggttctcaaagtgcgttctgatggtcctttgaaggtttctgagtagctttcaggggatctgcaactcaaaacaaggcttagggtgataccaacattatttacccttttcactcattttatagcaatggcacaaaagcaatgatgcataaaactgctggtgccttagcacagatcacggtagtggcaccaagctgcagtgctggttactgtattctttattgctatacatgtgcgttcaaataaaacaaaacaaaacaaacagaacaaagcaatctgctagctttgctgaagaatattcttgatgaaacaataagaatcattaattgtattaattttggtctcggagtacacatctagaagaaacgagaagtgtaaataaagcacttctgcttactgaatacagtggatgacctaaggaaaagtctccaaccaactgtttgaggacaaactatcttattcagaccaactatggttattcagacttgcttattttgtagacatttccttgaaaatgaagtgagcttttcacctgaagtaaaatcactaataatgtgtgttgccagcgaaaattagaattttggaaaacttgtgtctgcctctgtgaaactgactgcttcctaatacagatgtttcttataagatcagtagtaatatcaaaacgtgattttgtctgtattgatgaatgaaatgtgtccatgtttggaagatctatatatttcagtaaaccaatattttcttataaggtcagtagtaacatcaaaacgtgattttgtctgtattgatgaatgaaatctgtcaatgtttggaagatctatatacttcagtaaaccaatattttccacatgaccatgtatgatattgcagaaatcatgccccagtaaagaagacctgagccagccgtatgctagagcagcggattttaatagaacggagcacaaagaatcatggatatggcttcatatcccacatcgcagctgtcttttaaaaactgtgaattgtcaagttttggtgtagtagtaaagaaccatatccacagttatctgaaaaggcaattaaaatacttctcctggctgggcgtggtggctcatgcctttaatctcagcacttgggaggccaaggtgggcagatcacgaggtcaggagatggagaccatcctggccaacaaggtgaaaccccatctctactaaaaatacaaaaattagccgggtgtggtggcgggtgcctgtagccccagctactcaggaggctgaggcaggggaattgcttgaacccaggaggcagcagaagtttcagtgagccaagattggccactgcactccagcctgggcgacagagcaagactccgtctcaacaacaacaacaacaacaacttctcacttttcctcacacataactgtgtgagaatgcttttgttcatacacattaaacaaaacttttcaaattttccattaggccagacactaaggagatttgcgaaatgtaaaatagtgccactcttcttattcatttcttttgaaaatatggttattttgcatgagaatatattatatgtattaacatgtaatgcgttaccatactattgtttttttaaaataaataataaatatgtatacatttctcaattttgaatataataaatattggtagatatgatccacatgaacagaagcctttgcctttgcagtcttcagtattttttaagaacatataggggagatccttagactacatagtttaagaccagctgctttagagaaatacttctggaaaaaattctacagcaagtaaaaaacaaaaaacaataaaaacccaaacatctcaatttgctattctgcaaaaaataattttgtagccttttcattattttttgtaaataaaattttgcaagttatttgccataagaatgaagatatatataccttctgattcagttctaaaagattcctgtaattataattgtgctagataatatataataataattggattaatcaaattgtcatgcctcacaatttttaactgaattttttggtgtctattaattctttaaaaaataaatgtatgctatgttatgacacccaccttgcattccacaacaccattccattctgtatttccaacaagatgctcagcactaaacagcatagagtagggtgtccctctaagccctggccagcgaggaggcctgctgagaactcaccttgtgtgtgggacggttgtttgttttttgcttgtttcttttggagctccagatccctgtctgtgcgtgagttcccatccgccagctgctgtgggtgctgactgcacaggggctgcagctgcagccttggaaggacagcccttggtctaggggagctgccttgtgctggaggcgatggtgccgttcccagtgacccgcagccaatggctgatggatgcaggtatgaaaggcccctggcctccttggaggacctactgtcggtaagacctaccctctggtgccatttttatgctccacagctctccaagcacccggcaggggctggatcacaactcaaatcacactctgcctggcttttccccttccctattctctcccccactttcccccagcttcctcctgggtgcagttccttaataataatccttcagagccagagacaagaatttttgttctgaatatcccaccttagatgactgaactgagacataattccgtttgttcttgggggtgagggatttgggccagcggatggggcgtttgaatggggaccaatgagggtgtgaacattccattataaacatcattctttccttttatatccttaactaggactatacttttataacctaaacttttgtcatcattgatgtgataagtgtaaggaattcattgtaaatgtgaaggcttatacctttttgaaaacttgcactgaaagagtggttctcaactgggatggttttatccccgcgggggggacatttggcaatttttgattgtcacaaatgggggaagggctgtagtgcataagggccggggatgctgctacacatcctactaagtacagacacagccctctaaaatgaagaattatccagcccataatatcaacagtgctaagcctaggaaatctgattgaaagtaaaaaaattttccaatatagtgttcattaataatggagtgtagcctttccacaaaaactatttgtgtaactcaaatgacagaaataaagacataattatttgtcctccttaaaagatatgattgtatctgttttcttcttggtacatctcataaggagggaaaaaaaacacttcatgctagaaactattcagcttcattgagtttccccggaaattgacaagtgatgaaagcagagctgtttgtgttcgagttcctgtttatgtcaaatgaatttgaataaaacaaccagagcagaaacttgaaacaagtactcctcccatatgctcatgttttcatttaagacaaagtgtaagagaaaatgttgaaaggcaacagcctaatattctggccataatattcctggaatgttatggggccattctcactcagcacttggcatattttcacctttagcaaaatcgtctttgtgcttatgagtagtttgtgaaataactgcattaaggacttttctgttctggtttaagttaaaaaatgattactttgaagtatcactatgtactatatcttaaaagaataaaacattaatagaaatcaattaattatcctttgactttgacctggaatggctactgctgagtgctgtgtattgatcacagaaatcttgaacttctcttttagtgttgttagtggggctaccggctatcgggtgcatgtagatattaattttctctaactcattcttgtcacagtgatatttccattgcattccatcctgttcggctcaaggcattttcagactctttgaaaataaaatcttctttctcttctctataaaatcttatctacttctaattttttgtctttactccatactatccccaaatctgagagcaaaaattccttttggtttcctgttcatgaacatatttgtgtatgaactttcttttacagtaaaataattggcagtgtgccttttggctcaagtttgtcttttgttctccggctttgttatctctcttggcccaagttcaagcatctccttcagcatcttctgtggtgtgtcctgtctttgcaggtaggaactcaaggtgactggttttaagccaaatattctcaccaaaagtagaattgacccataaatacttttgattctattctttttttttttttttttttgagacggagtctggctctgtcgcccaggctggagtgcagtggtgcgatctcggctcactgcaagctctgcctcccaggttcccgccattctcctgcctcagcctcccgagtagctgggactacaggcgccccccaccacgcctggctaattttttgtatttttagttagacgaggtttcaccgtgttagccaggatggtctcgatctcctgaccttgtgatccgcccgtctcggcctcccagagtgttgggattacaggcttgagccaccgagcccggctgattctatttttaaagaagctcttctttaacttctctcatttacagtggactacatattttgtaagggcttcagtaatggatgaagcatgaatatgttccagacattttaaagggaaatatactgaaaatcgagtcgtggttgcatttttctcccccttcataaatggcaataaatttctcagtcttgtttgtccagtgaatttgaaaaattcgcccaaaaagtacaaatggaatgatggtctatttcattgttttcaaaattttttttttaaacagagatttttaaaatttaatttaatttaaagttccggggtacctgtgcaggtttgttacataggtaaacatgtgccatggtagtttgctgcacctaccaacccatcacctaggtatgaagcatggcatgtattagctatttttcctgatgctctccacccgccccccacctagttccttccctgacaggccccagtgtgtgttgttcccctccctgtgtccatgtgttctcactgttcagctcccacttataagtaagaacttgtggtgtttggttttctgttcctgagttagtctgctgaaggtaatggcttccagctccatccatgtgtctgcaaaggacatgatctcattccttatagctgcatagtattctatggtgtatatgtaccacattttctttatccagtctatcattgttgggcatttgggttgattccatgtctttgcaactgtgaatagtgctgcaatgaacatgtatgtatgtatgtgtgcaagtatctttataacacaatgatttatattccttgagtatatacccagtaatgggatttgtggatcaaatggtgtttctggttctaaatctttgaggaatcactaaactgtcttccataatggttgaactaatttgcattcccaccaacggtgtaaaagcattcctatttctctgtaatcttgccagcatctgttgtttcttgactttttaaataatcaccattctgactggcataagatggtatctcattgtggttttgatttgcatttctctggtgatcagtgattttgagctttctttcatatgtttgttagctgcatgtatgtcttctttttagaaatgtctgttcatgtccttggcccactttttagtggggttttttttgtttgtttgtttgtttgttttttgagatggagtcttgctctgtcacccaggctggagtgcagtggcacaatcttggctcactgcaacctccacctcctgggttcaagcaattcttctgccccagcctcctgagtagctgggactacaggtgtgcactaccatgcctggctaatttttgtattttcagtagagacggggtttcgcaatattggccaggctggtctcgaactcctgacctcatgatccgcccacctcagcttcccaaagggctgggattacaggtgtgaaccactgtactcggccacggttgtttgtttctttcttgtagatttgctttaattccttgtagattctggacattagacctttgtcagatggataggctgcagtaattttctcacattctgtaggttgtctgttcaatctgatgatagcttcttttgctgtgcagaagctctttagtttaattagatttcatttgtcaatttttgcttttgttgcaattgcttttggtgatttcatcataaaatccttgcctatgcttatgtcctgaatggtattgcctagattttcttctagggtttttacagttttgggttttacatttcagtctttaatccatcttgagttaattttttgtataaggtgtaaggaaggagtctagtttcaattttctgcatatggctagccagttctcccagcaccatttattaaatagggaatcctttctccattgcttgtttttgttagacttgttgaagatcagctggttgtagatgtgtggtttcatttctgagttctttgtcctgttccattggtctatgtgcctgtttttgtaccagtacaatgctgtttttcttactatagccagaggtacaaggagaagttggtaccatttcttctgaaactattccaaacaattgaaaatgagggactcctcgctaactcattttaagaggcaagcatcatactcataccaaaacctggcagagatacaacaacaacaaaagtttcaggccaatatctctgatgaacatcgatgcaaaaatcctcaataaaatactggcaaacagaatccagcagcacatcaaaaagcttatccaccacaatcaagtcggcttcatccccaggatgcaaatctggtccaacatacacaaatcaataagtgtaattcatcacataaacagaactaaagacaaaaaacacataattatctcaatagatggagaaaaggccttcaataaaattcaacatccctttatattaaaaactctcaataaactaggtattaaaggatcatatctcaaaataataagagccatttatgagaaacccacagccaatactaatatcatactgaatggacaaatgctggaagcattcccctggaaaactggcacaagacaaggatgccctctctcaccattcttattcaacatagtattggaagctctggccggggcaatcaggcaagagaaagaaatagagggtatgcaaagaggaagagaggaagtcaaactgtctttgtttgaagatgacatgatcctatacctagaaaactcctatcatctcaggccaaaagcttcttaagctgataagcaacttcagcaaaggctcaggatacaaaatcaatgtgcagaaatcgcaagccttcctatacactgacaacagacaagcagagagccaaatcatgaatgaactcccattcacaattgccacaaagagaataaaatacctaggaatacagctaacaagggaagtgaaggacctcttcaaggagaaccacgctgctcatggaaatcagagaggacgcaagcagatgggaaaacattccatgctcatggataggaagaatcaatattgtgaaaatggccatactgcccaaagtaatttatagattcaatgctattctcattaaactaccattgacattcttcacaggagtagaaaaaactgtttggaaattcttatggaaccaaaaaagagctcgcataacaagggcaatcctaagcaaaaagaacgaagctggatatgtcatagtacccagcttcaaactaagacagattatgtcatactacccagcttcaaactaagacggattatgtcatactacccaacttcaaactaagacagatttgcagcttgaaatgtttacaacctaatgctgccaatccttaatgtcttaaatacaatgaatttttgtagtgcttttcgagttcacaattcgaaatgatataaaactggattacagacaattacatttcccatattatttaaaatatgcactggtgctacaaaatttttctataatgatcattatatatatgtaatattatataagtgtgaaagtataatattatgtatgtcatatataatatataaccataaaagtagattttacatttatgattagctaaaaaattttgagacagaaactctgcgttttgcatattatgtattctcttgtctttcctaatccctagtaaaaaataaactttactatgtaaaaatctgttaatttgaagtcaaagcatggctgtattttcagttagttttttaaaaaaatgttttttttctgtagcaaattgttgacttggatattgcttattttgaggttcttcctctttcccctcctgtgccctccaattcagtgtaactgctacctctctaagtgtcaaagacaaatgatggatggttgttcagcttctttgaaatgcagcatgttttagtgcctttttacccttgactttcatcactagtattgattgatggtatgttatttacctggcattgaaggactactggtttataacattcaaggcaaaacattttaagtagtatgcaatgcggagatttctttctactgggcaaggttaatgacctaccaaaagaggaggggtcggtgtatgctgggaataattgatatcttctgaagccaagattgacttgtggggtaattttcatatccttgtgataattaagttagtagattttcatctttttaattgccctcaatttcttcagaagggggatttaggatgattagccttttatggtcaacttgctgaaaaatacctatacaaagcttgtatttagaaactagagtcctttttttcttctcttgtttaggtgatgtcgtcccacaataacacttactcgacatttatgtaggggaggtaattcttttggttgtactgcagagaccaagaatacattttgtacttcatttacattccccagaatacttaatataatgttgatgacatggtaagaacacaatatctcagtattttgtggctgagtgaatgacaatgcataaccttaattctaatttggtgtcaatctcattttttaaactttctgttttcagaaaatgagaaagggcagcaaagattttgttgaaatatgattttcagaatcttgaatttacaagtgtttgtttgtttttgattataccatggttatactatagatgatagagggatgattttgaatcaaaaagaaaaaaaagaaaatatatgtatggaggctgaagtcatagacaatttttgatgggataaatgttgccaataatttttccattaggctttagtttgtgtgttcagcatttgaattttttttagttcattttcaggtcacattttagttttatgtttcttaaaataacaaattaatggagcattaaaacatcaaacagttttgaatctttcaagtattgaaaacacattatgctgaaatttttgaaagtaaaaacagtatgaaggccaggatttccagaagattgacataaatgagtgggatatcatctgttaacttttaaataaacttcagattgatttgtgtctgggaagaagacccttttctatgcaggctggaagggggatttgctggcattcccgagtggttacaactttgtggagttaatatttaatgtgccattttatagcatatacagatttagaagctgaaaagatactaagacaatataatatgaatttatcatcaatttcatagcatgaaactgaagaaactactttttgtactgttttaaggaaatcctatcatcatatggtgactgtacaacattaaagcaacattctggaaagaaattgccaggtatgtagtcacaggttcaaagaatgactggaaactgaggaactttcacatagtgtataggaatttataacaagttctgacagcattgttaactgattaaaaatacctaataaggctgctggatttgttaatgagtacttttaaggcaaaattggcaataaaacaatagcatttgtttaaacagaaaaaaaaattcccctgcattccttcttttgaaaggaaacagccgcgttatgggagttctcatagttatatgttgaaacagggcagcttttcaaaaactgtcaagtttagtgtttcaaaggcatgttgaagaatgaagacgggggtgtgtgtaaataaatgtgctgattgcataaaggctgcttctagttttgctcaagtgattttagagcttctgaaggagcagttttcaaccttaaatatctaagtcaacactttttctttagtaagagaggtgaccttagaaatgtccttggtctaagtgaaaatactggccaattcaagacacagcaatgtagatcaatccttattctttaactttctgaacaaaagtttaaaaacattccaaatttattttcattgatggaagagattcctgtttatattttgttatttttaaaataaatgaaaatgaggttatcagtcaaaggtggtttgaaaaaacttctactccatttccagcgtgatgtcagggaacccgacagcagtcacaggcactctgctttcacactaataatttgtgatctaatcggtaaaattagatcagtatgcaaaactattagatgagttaatagtcaaatggtagagttttaaagactcctagatccggtggttctattttgttacacgtcttctaggaagcttagaagattgctttgtttggttgattcactacctgctgcatctttagccttgacttaataatgaagtaaaaataataaaacaaaagacagtaacaaagtcaacagaaaatcctctctcccaaataaacccaacaacaacaacaaaaaacaaagtactcagacaaatagctgggggagatttttagaaattgagagttttttgaacatgtaattaaatttaatttagtttttaaaaaaccttttaaaacacttcaatgggcagggccttttttaattgaggtgaaattcacataacataaaattaactattttgatgtgtacaaatgtattcacaatgttgtggaaccataacctttacccagttccagaacattttcatcaacccaaaggggatccttttcatcaaccactaatctgttttctgtctctgtggattttcctactccagacatttagaatcatacaatatatgactttttatgtttgcttcctttcacttaacataatgttttcaaggttcagccttgttatagcatgtgtgagtacttcattactttttgcaggtgaatcattccattgggtagatataccacattttgtttatccatccattcactgatgtaaatttattgatttttcaccttttggttatttgttaatagtgctaatatgaacattggtgtacagatatgtgtttgaatacctgttttcaagtctttgggctacataaataagaatggaattgctgggtaatctaatagttccatgttaacttttcggggcaaagccaaagtagtattcatggtggctgcatcttttatattgtagcaatacacaaggcttccaatttctcaacatcctcaccagcacttgttatttcagttttttaaaaaattatagccaccttagtggatgtgatatggtatctcattatggtttcaatttgcatttccctagtgactaatgattttgaacatcttttcatgtgcttgttgaccatttgtgtaccttcttaggataaatgtctgctcacttccttttccaatctttaaattgcattgtttgtctgtttgttgttgaactgtggtgctttaaatatatctatctatctatctatatacatattatatttatatatatacatagagagagagaattttctacatacaagattatgtcttctgtaaatacagatagttttacttcttccttttcaattaaaataccctttatttctttttcttggctaattgcccttgcttgaacttcctgtataatgctggataaaagtggtgaaagtagcatccttgtcttattactgatcttggagggaatgctttcagtctttcaccgttgagtatattttagccatgggtttttcataaatatactttattatgttgaggatgttccattttcttcctggtttatcatgtgtttttaccatgaaagcatgttgtatattttcaaatgttgtttcagcttcacttgagatgattttgtgttccctccttcattctattaatgtggtgtattatattcgttgtatatgttgaaccacccttgcattcttgggataaatcccaactgatcatgatgtataattcttttaacatgctacttcatttggtttgctagtcttttgttgcagatttttgcatttatatttagtagggatatctatctatagttttcttttcttatgtgctgcctttggctttggtgtcagggtaattctggcctcatagcttgatttaagaggtgttattttcttttctaattttctggaagagtttaagaaagattggtgttacttcttttttaaatgcttcatagtatttagggtgaaaccatctttagtactttactttttaaaaatggtaactatggacagttaaacctaaagtatcagaattcaaatggaaatgttttaaatttggcaataacaaaaaattataagttcaaaacatatctgcccaaacaatgactaataccacttccaaaattatctacttaatagatagtgaagggatataacattgtttttatattatttcaagatggggcaaaagttaacttctgttaagtaaagtctacacctatacaaaatgttgctcaatatgttcttgtgtttgatagcatggtagggtgaatatattgaacaatatattgtatttttcaaaatagctagaagagaagatttgaaatgttactgacagaaagaaatgataagtgtttgaggtgatggacatcctaaataccctgacctgatcattacacactccgtgcatgtatcaaaatatgtaccccatcaatatgtgtaagtattatgtatcagtaaagaataaaatatgttgaaaaatggagacaattacccaaataaataggaatatgattgagacatgggttggtattctaatgtattcagactattatcttaattctccattttactttacccatataaaaataatctcagttactcttagttggaaatttgtttcaactagaaatagaggaatatctccaaataattttacaactttattttctctcttagactcattgttttttccacaacatcaggttaatggtttaaaaagctttgcacaacttctgtttggttaagattttttattttatatacatagacacacacacatatctattagtcgatcattcagatatacaactaactagatttaaaaatagtaagccatggtttatacatcacatataaatgacctagataccagtagtgacattatcatcatgaatattagttccagaaagtatagatcagagaatatttgggaagagagatccaaaacaatgtctgacaagtttttgaggaatggggaatgatgatgaacagtcatgaaaataacagaattaaattccaatttgtttttcagtagaaatgatgttaatgtttagatggctcctgtcagcattaaatacacagttaagtacagaccttcagaggcagggagttggtgatttttctacctcttgaaataagtataccatacaaaaagcgctattttgcctgcttgaaatttcagaaaggtaaacactctgaattggcttagtgcttgggctattggcagacctttcacaagaaaaagtttttaggcagcgtctatgtgaatcataccagcttttctcaagataagggattcatattagaaggcttgactcactctgacattttatatgactttctattattgaaacaactctaaaggtcttttgagcattctattcacagtgttacctaataataacatatattagcttctggagtttaagcagcttataggcagagttcacataatcactttgaacgcctggcatctacgcagcaagtgtgcaataaatatttattgaataactaatcttacaatgaagaagcagcatgaactgggaattactttccattccagttctgaagtttagactcattctaagaactatgaatgcttacatctgtgaccttaatgtacctagatttcagttttcttgaattgagtttgacgagtgtatttctgaagccccttctagcttctaaatgtcatgacatgcgttcaagatgagacttgtgagtatcttttcaactaaactcagttctccaggtctttcaccacctgttgtaaaaggtaaagttgaatggacttctatcacttggatcttatttaacttgaattgctaaaaatacacgtacagccactgctgaaattaaacagcatctacaaatgcaggcattactctcagacattttctaagtagaatacatggcctctactcccagggggtttataatctagtgtagaaaaaaggaaatatatacaaaatgatgcaactgacatgagggaatttagggtgagttggacagtatttttaaatttctttgctgtgagtctagatttagttgagacttgaaataagtatacgtagcaatgaagaagaaaattataaaagctttagaaaataagaagcccatgtagagaagattgaataattatttgtttttaggagcatattcaatattttctgaatccatgctaaacctttcctcttcttctctaagctttctccagataaaatgtggcacagcctccgggacagtctcctccagactctggtcatattaatggccatagagagtcagagccacgatttttgtcttacacctcttttctctatgtacccaatgtttccttttaattgattcactgcttagatttaaacaaatgtttgttagaagaaatttaaatagaaaacccaattcattatatatagactgtaattataaagataagttcaatgaaaataaaacaatcttaaattcttcctgtgtactgttgacttactgaagcttctgtacctgaagccttctctctctcttttttttttcaattgaaccttagcacatgtcagagagtttattaaaaatggtagtattcccaagtggagacatcttccttgaagaattcagaagaactgagaagagttgaatgagaatggaaagggaatcactctatggggatagttctataaaccaggtggctttgtttatgcatactccttctgaaaacaccatacttctctacggggaggctggaggaagcactgttagtattgtttccatggttttgttagatgtcaaactcagagacattttttgagttaagtgactcacagactgaagaaaagtatgaggacttcaagccatcaaattttctaagttattgagtataattgcagtggattccctacctgaagctgagtcaaccaggaaaattgtactgtctaaattctttttccttttctcttgtcacccatggtgaatttttccaatgatataatcaattgatttttaccttatgacagtgggagaggacaggtaataaatgtaggaaaaccaggaaccaaatatgatttaacatacttggagttcacagatagcagtgatagaaagttgaactttaaaagcaaaacttaaagaaatccctttattttgttaaagaaagaaaatatatacactggaggatcataagtaaaatattccaagtacagttaccagccccaatgagtgagatccatgcttagagacagtcgtgattcttatttaacattaataaccacaaactgtgcaccagatgctatgaactcaagtccaaggtagatgatataatcaatatcatcatcactacagaatatattaaaatattattttactttagaagttgcctttcaagttaactagtatttgagcactttgtataccaaaaaaataaggtaaaacaatagtgaagaatccaagattatgggacaaaacccatcttcaaggaacttatgatgtacgacagtaatatcctttagtgaaaaagcatagcctcgtaagagatgcttgcagggatttaatagaagaaaggagcacactggaaaaggaggtggcttcatgaaggagcattttctatggagcgtgaagaaagggcaggctcttgacagggaattatatagggtgtaggacacttggctggacatctacgacagcgagacaggtggaaacagcagtgagaaagcgtgttgggtagttagtgcaaagcccagctttgttggaatagaggagaacaggaagacctgaggctgggaagagacgccaggatgaagaaagataagcaaagatttgtgactagcacagaagaactcgccatttgcagaattaagtgtcactctaatgtcaaggacaggcgcaaaccatggctctaacattaggcaagatgcatagtcttttaagcatcatcactggcagagctcctagatagatactcgtaatgataataggtaccatgtgttgaatgcatatcaagtgctgggcatagcactgggtggcttagatacactatacttctgtgacagaggcatcatctttattttcccagaccacaaaaaaaaaagtagagcctcttaaggagctggaagtcaaggataaataatttgtatcactctggtacaagtagtcattttagtttattacctaggtatcatcaaggaagaacgggctcataaatgttttgcagttaacatgcaaagtcctagaacatctcccacgtgagattcctaaacagttcttccaatctataatatctggtaatgaaatgcaaatgacaataaaagggcccagttccattcgcaagccatagttcataacaaatcacaagggttttctatggcaagcagcttcttgagaattgcagtcacacttgacatggtcatcagccatttttcaagatgccacgtctcaagcggggctattaatcccatttcttgcgtatttcaatctcattttacaatgtgaaattgctaggagacacacatttatcaatatgttccataatgttgtttggcatgacttctttcagtacatcgtattttttgttacatgatcaatatgagagtcttctctccagaaaaggcaactaatcttgctacctagtttgaagtggatggcttaaactatttacaaaaatccccctggttatttttctttcccgagtctctttccttatccttaggcccctttataaataagcttgtttctttgcagtctgtggctccaaaacatgaatgattattggaatatcagatttagttggcagctgtttatattaatgtaacaaggtgacattggtttggtctagaactagaagttattgttaggagaaactgaaaaactgttcattaaaaattataagaaatgcttttggtttctaagagaagtctgttaatcagggttctccagagaaacggaaccaatagagagagagagagaaagagaaagagagagagagagagagagagagagagagagtgtgtgtgtgtgtgtgtgtgtgtgtgtatctttgagggatatattcctcttgtcctgaaaaatcattccatagttatatgtagagagattctggtctagaatggagaagtctgaagttatggccccagaggactacaccgtcctgctctactattgttaaaggctgtccctgcaggttttgtttcctttggagaactgcttgttttcaaaatctaaatttatactgccatgagtattttaattattgcttgtccttggaaggtttatatgtgggttgtctgtgtaggaagtgttttgagcctttgctcattggaatttgggagccaaggaagggacgtacaccatggagtggcttggaggtagttgaggagctatgcagacaggggaaggagagtggtggtgctgggactgtgcagtcattttaagttattctgtgtgttatgttcccccattattatggaaactgtagcagatccccttagaaataacagccccatctctgatagtccatgggaaagccattccctcgacaaaatcacagtgagtacatgttatggactgaatgcctatgtacccccaaaattcatatgttgaaatcctaaccctaaaattaatggtattaggagatggggtcttagtaggtttaggtcatgagagtggagacctcatgaatggaattcgtgcccgtataagaagagacatgagaacttgcttcctctgttctctttcccatgagaacacagtgagaagacagccagtcacctgtaaaccagaaagcaggctcttatcagacgtgggatctgccagcaccttgatcttggacttcccagcctcaaggactgtgaaaaataaatgttgtttaacctcccaagtctatggtaatttgttatagcagctggaactaagatggtgttgccatggtgattacaagtggggcaaatgaattcatgcatttaacaaatgtttactgagcctctactctgtgctagatgcagcagagagggagcttggaataaaatagagcaggaagtgctagccagagcagtttggcaagagaaagaaataagaggcctccaaataagaagagaagaaatcaaactatctccctttattcatgacatgattgtcttcttagaaaaccctacaggctctgccaaatgctactagaactgataaatgattttagcaaggttttgggatacaaaatcaatatataaaaatcagtagcatttctatacaccgataacagccaggctgagcgtcaaatcaagaatccaatcctatttacaatagccacaaagaaaatgaaatatctaggaatatagctaaccaaggaggtgaaacatctctgcagggagaactacaaaacactgctgaaagaaatcagagatgatgcaaataaatggaaaaacatttcatgctcatgaactggaagaatcaatgttgttaaatgaccgtactactcaaagcaatttacagattcaacactattcctatcaaatgatcaatgttgttctccacagaattagaaaaaaccattctaaaattcatatgcagccaaaagagttgaatagtcagagaaatcctaagtaaaaagaacaaagccagagacattatactacctgacttaaaactatactataaggctacagtaaccaaaacagcatgatactggtacaaaaacagacacatagactaagggaacaggataaaaaactcagaaataaagccacacacctacagccatctgatcttcaacaaggccaacaaaaataagcaatggggaaagggctttatattcaataaatggtgatgagacaactggctagccatatgcaaaagaatgaaactagtcccttgccttttaccaatacaaaaagatggagtgaagatttaaatgtaagacctcacactataaaaatcctaggagaaaacctgggaaatacctttcttgacattggccttggcaaggtatttttggcttagtccccaaaagcaattgcaacaaaaacaaaaattgacaagtgggagctaattaaacgaaagagcttctgcacagccaaagaaactatcaacagagtaaacagacatcctacaaactatgcagctaacaaaggtctagtatctggaatctataaggaacttcaacaaatcaacaagcaaaaaacaacccaattaagcaaaggaaatgaaaaggcatttctcaaaagaagacatacaagtggccaagaaacatataaaaaaatcctcactatcactgatgatcagagaaatgcaaattaaaaccacaatgagataccatctcgtatcagtcagaatggctattattaaaaggtcaaaaaataacagatgctggcgaggctacagagaaaagggaatgcttatgtactgttggcaggaatgtaaattagttcaactactgtcaaagaaatccatttggagatttctcaaagaacttaaaacagaactaccatacgacccagccatcccattactgggtatatccccattggaaaatagataaatataccaaagagacacatacacttgtatatttattgccacactatttgcaatagcaaagacataaaatcaacctaggttctcatccctggtgaacaggataaagaaaatatggtacatatccaccgtagaaaactacgcagccataaaaaaagaatgaagtcatgtcctttgtagcaacacggtgcagctgcaggccacaaccctaagtaaattaacataggaacagacaaccaaataccacatgttctcacttataagtgggagctaaacactgagcacacatggacataaacataagaaaaatagacaccagagactattagaggggagagggaaggagcaagtcatggcttgaaaaaccacctattgggcactatgctcactacctgggtgcaatatacccatgtaacaaacctgcatgtgtaccccctataactagaataaaagttgaaattaaaaaattagaacaaaacaaaacaagtacttatcttcatgaagttctaatgaggagatatcaatgacaaataaagaaaaaatatgtaaaataaataacaagtgctgaaaaagaaaaacagagtacaggggctagagttctagagaggttctattatagatggagtgatttgggttgactgggattaatcatcccaggattacattccaagttcagagctgtttctcttatgctaccattcatctcatttgtagttggggaatttagtcagatggacaaataattgcatatctttttttagggagagctcaacaatgtgacgctgtttatgttgatgctgttgaaatagtgtgtcagcaaatccctgtctttttccctgttcagtgtccttaacgggggaggggatgttgaaacctgatcccttccaagagtctaaggtatagccatataagccggagtcatatgaattggtagttgaatctaatgcttgtagcaatattcctgtcatgaacagaatacactaaatttgtcatttatagttttaacaattcttgagttatactattatatatgtaataggtcctagtttggttttattttacttaaacttacctatgtacacacttttaagaagtaaataattctataaggcttgttacaaaaagcatcagctcctgactgccctacctgctttccttttgctgggaacaacccccttttaactcttagctaattttttttctagttatttattaccatgcctctaattaacaggtttattttgctacttcttaatttttaacagttttttcagtacttcttgacttttttggttttatgtgttaactactgacttcccaaaatgagagctgagaatttgactctctttgtaaccgctttcccctccatccctcttaattcctcatcccaacataaagtaagagtaagtgattttggttggcccacccttggcccaccctgggtatttgaatatactgtattaggacggcgtaaacattgttaacacctgagccaggtcatatgtatgattttctcatccttttctacactctttaaaaaacccacttgaactagtaactgtttgcttctgttcttggtttagatttgtatgttcttatcgctaatctactctcaaattctcctaccgttccatttgatagcatcttgctttttttgcagggtgcaatatctttcctgcccaggtaagcagaggactgcaggatgctgcgactaggttccttctttgaagatccccaacttcattagtcttagattttattctcctttctaagattccccagaagactctcctccaattctggcctggagtatataaactgcccatatcagatgtgttattttatttaaaaataatttttgagttcttttattattgcaaaagttctgttggtaaaataaaactttagaaatgcaaaaaaaagaaaacagatatacatttttaattccactatgaaaacagaacaacaatttaattgcttaatttcttctgtttaacaaagaaagttggagttggcaatacagtaggcactgaacacttctgataaagcattaatgcaaaaatcaatgtcacatcaaatacataaagtggtcaatatttttgtgttaaaagtaaaaagcacatcttaaacattaactttgaaatagattgatgtgcaaatctaaatttgttttgcaaagccactgtttcaatggaaagcaatgcgtaggaagagaaatcatgtgacaatgtattccaccctagtaatatgaaatggatcaaggaagcagaaggtatatctatttaagtttgattgatggttcaagaggattttgtaagtgctattgtggatgtaaaagtttttctaagaagttggggagattatttcaggtaaccctgacagttgttcccatccttcaaagtctagagtactgcaataccttgccggtagagaagacactttgcagacggcattggagaaaaactgtgccctttactctcccagcgactgaacagatctcagtattgctattagaaagaaattagtcatgagctattggcaagtaattgagtaagatgtctgagtatttttttaaaagtttaggtgggttgaaaactctctgcaataatcttccagagcacaatgcagggaagggactggctgatataaagctgcctgttattaaattatcctgggatgggaagcaagcaattatggggttacctgggatggtagggagcagaaaagcaacaaatgctgagaaattagatgaaacaacaatttaaaaaaaatgaatctaaatccaagccaagttatcttgtagactgctactgaccaaggatttagaagagagcttttatttatttatttattttttgggacagaatcttcctctgtcacccaggctgaagtgcagtggcacgatctcggctcactgcaatctctgcctcccgggttcaagcaattctcgtgcctcaccctcccaagtagctaggactacaggcacgtgccaccacgcctggctaatttttgtattttcagtagagatggggtttcaccatgttggccaggctggtctctaactcctgacctcaggtgatccgcctgccttggcctcccaaagtgctgggattacaggcgtgagccaccacgcctggcctagaagagagctttttggaaaaatgcaaataacaatgctaattgtctctgattcttttaaattgttggtaggtgaatgtatctatgcaaatgtgcatcgtatataactttcagtaagctgttcattggataacggtgattcagcctgagttatctcaatttgttttctctaatgttacaacatttcaggtggtacggttcatctggaccagcctctgatgtggggaagaccaagcgagagcacactgcggagagtgagtcctggtcggtttgggtatggctctcagcagactgacccacgagggccagcagctgctggatttaattcgctgattttgtatgaactgtagatttccctgggaaatctgctatgcacacacaagtgagaaggcaaccatgagaaggaggccagggctgaggctctgcaagtgcacacggctcgttgcagaaaagcacgcgcctcccagcaggactgttagcccagagaggaagcctgctggggtttgagctcatttgtgttgtcagtatctcttatcacagcatcagattcagtgttttcttaaggaacaaaacacaggaaacggcttgctgtcattttctatttctctagtgaatctcctgtaactgaaagtcacaaacttctttctttaagacctatggcttacctttccaataagaagtgaaaggtctaggctgtcaatatttgaaattgaggggcaaaaggcagcctcttttctatcatgaaggaaaacatacaatgtggaaaagagttcgctttggagtggatttatcgtcatctaaattgaatgcattggtgaagattacggaattgatgtttccaaaattcgttgacatgtgcagatgaaaatacaaaggattatttttaatattattatgttatattaaataaacttgctgagattttttaagtttcaatgccttcggcctccagtagaacagttgtgattaaaacaacacatatgcttcccatttggctggttatgggaatattttgaaacaaggaatattttaaagttaattatacatgcatttaatgcccagttaaattttgaaagtatttaacaatttgcagtgggaggtaaagtaaatgtctaattctgccgctttctctgtggttcagtgaagcatcttcttggtcattgccctaactgaatctgagctaggatgttccatcacattgaccttgttataattttgaaacaggaattccagtaggatagaattgttccattctgttgcccctctaaccactccaaggtttcttgatgtatctagctcatgacagaaaagacaaaaaaacaaaaattactctgaagacgaaaagtcagcttgggaaagttatgtatgtttcctttttaaaagccttttaacctttggacttgagaaatgctttttcttgtcttttaaaatgtgttaagtagtcacatcttgaaaaggaccagataaaatcatgtttttcaggccagacatggtagctcatcccagcagtttgagaggccgaggtgggtggatcacttgaggtcaggagttctagaccagcctggccaacatggtgaaaccccatctctactaaaaatacaaaaattagccgggcatggtggcaggcacctgtaatcccagctacttggaaggctgagacaggagaattgcttgaaccagggaggcggaggttgcagtgagcctagatcgtgccactgcactctagcctggtcaatagagtgagactctgtctcaaaaaaaaaaaaattgatttttcatgtgcctaagattaaatttagggctcatctaaaccccaagggactttttatgtatttcacttggattttggacaatagaaatgaataagttggaatagatcggatgttacatggtggactctacctatagaatgccaccaaccatctcctttatgtgttgtgaatgacccaagccagatcatgcaagtctccataggcatgcctcttcttgtcagatacttctaattgagtgtgatgattttcctgctgagccttggtgtagctttacaaccctactcaacacagctctgtgggcagcaaagccagtgggcaggaattattaagtgagctgaaactgcttctctaacctaggctagaccaaacaataggaagtcaaggtgatatctaggagttgtacatattttcaaatataaaaatatttcattcatttggaggaaggtaggatgaacaaggtagacagtactaatatgtcagctggtaagtaattattcagtgccatttttgctgggaatttacctggatacagatgggcctcctggaagaatgtggcatttcacctcctctgtacagggacttatgacttcactgcaagaaaatagttaatatataacataatcagtaagcgttaaaacactccataatatgacaaactttataaatattattccaaccctctcactcgaaatgaaagaagatttcatagacaagaaaggcttcttagagacgatagtatggttcatgtcacaaatgttaaatggatgcagaagcatttggaatgtagcgtgcgggatgctatgagttggtgtgtctaaaaatgttcaacaaaatcaattgtagactttacctcacaagaaagtcttgacttttgcaatggagaaaagtggtgttttatagaaatactttaaaaacaatttttttaaaaattacaggtatttcagaaaatgagagataactacagccaaataattcacattaaattgttgattgaattgacaaagtaatttaatgtgtttctattagatgcaaggcagtgtgctggatcattgaagtatataaaaatgtatctgcttgtaaaagcagataatctagagatgaatgtggtagctaatgaaattacaaattagtttatgatatgtgcaaatgtgggaaataaaatcacaaaaacaataagtaattctaatcaagatacctgtcaagttcaaaaaagcttctaagaactatggtaccttggaatctgatttaattctgaaaatccaccacattaattatgtctttcaaatttaaaaactaagtttctaaatgcatcaatggcccttagaataaaaactcagaacatttagaaacccctggtaatgacaggatcatgtctaagtttaaaataatacggtttattctcactagcctgcagaattgtttataatctcaagtcgtacttcagaacatagacaaaaggccatccctttttggggtttagatagaaatagctgatttcacctgaactcagcaaccttgtaaatagccgtttctatgaaatatatctgctcacttggataagagccaagtttcacaaattactaatgctggatctaagttgactagtgaaacttattcccaaaacaggcaatgtgataattcaatattttgctgttgatgtgtttcgagagccagcacacagtgtgcatttcccggttgctcccagcttattttgccacagacctacagagaccagacttcaagatgttcctgtggacaggaatttacacaaaaaaccaggtgaaatttacttttttggtggaaaaatatatatgtatgactggcttaaagtcgttaagtgaggtgatcttaatgataggaccaaatccattagaaaactactttgcaaatgaagtttaaaaaattttattttcaactagtttttaaaagacttcaattcagtaaggagcacattagaaagatctcagtttatctcaagtataggctatatctaaagaaacttgattatttattaagttttctttcttattaagatgtcttggctatacagcaagaagcataagtaactctccattgcatattggatcccacgttttgtggatatgaaagagttagttttagaagaaatgtcataaccaaaaatagaaccaaatacatagctatgactgaagtaaagttcttgctgtatggtaatgcttcttgcatttggtcaatctgaagatgcgtgacatcaagcctgacacagtcagtttagcatagtctccttaaggtttgactatggaatgtatgaattcgtaaatctgctttctctttattgaatatattcaaacgtatcacagctattgatggattccatgctttgtttacaagaggagcacatggaagtacacaacccaggagccatattttcctcttactgccaaaatcactcttcagatatgatttaggtgcttggatatttgcatctagttcactttacttactttttactgctttgctggggcaatgctttccaacaataagaaagaatgaatgaattctagaaaaggatgagcacatgaccagatccaagcttggaaaatttgagttcatgatccattcattgttggaatgttcagggtcaggaggtgaaacttcaagtcctaaattctaggtctatggctaggcaggacatcttccttttgccttccagatacccactccacccttctccactctgctgtgtgctctggaggttgacctataggctccacatcaatgcacctcccttgctttcagactttgagttaggtccaaccaacagggagcaccacctggagactgaaggaggcagtaagcaggcggtacctgcctgcatctctctccctttccctgatgttctggcaactgcttcctcctgttactcccacaggccgaggagtactaattgcacctcactgtccccatctccaaaatgctgctctgacccctccgcactttcctataatccctcaccttataaacagtccctgtatcacgcttttggcaaatttatcggctgcccactgactatctgatgcaatctgcaatcacggaactcatactatttggctaaagagttgatgacatttgttgtgttgtcatggagtttgaggtgctggtgcactactttgccagataatcagacaacgtatccccattgtgggataggggaagcaaaacaaatgtttaactgttcaagggtattaattcagtcatggttttaaagacagaattaaaaatttcaataaaaaacatagtcatggctgggtgtggtggcttatgcctgtaatcccagcactttgggaggctgaggtgggtggatcgcgaggtgaggagatcgagaccatcctggtcaacatggtgaaaccccatctctactaaaaatacaaaaaaaaaaaaaattagctgggtatggcggcttatgcctgtaatcccagcactttgggaggctcaggtgggtggatcacgaggtcaggagatcgagaccatcctggtcaacatggtgaaaccctatctctactaaaaatacaaaaaaaaaaaaaaattacctgggtgtggtggcttacgcctgtaatcccagctactctggaggctgaggcaggacaattgcttgaacctgggaggcagaggttgcagtgagcagagattgcaccactgcactccagcctggtgacagagctagactatgtctcaaaacaacaacaacaacaaacatgatcatatggtttcacatactatttatttacaattccaaaacatcataaatacatcctatatttcatggttcagtggagttcaggaaaagcaagtatttgagaaagcaacttgaatcaaagaagctgggatagttctgaagaaagggaaattaacatctcccccaaatgcagatgctttccatgcacctgtactatagaattgtggtatggagatatggaacacgcaaagtcattctacacaacatgatgatggagccattcttcattttttcactggtctggaaaagactttgagaaatagggctacacttaagcatcttagacatatttctagaattttggagtttgctgagaaccttgaaaatattaggcactggactggtttgacctgccgtgacgtacaaggcacttaggtttgttatgtttgatacaagaaagcctttatgagactgttcaacagaaaatcttgaattttttactgatacccattaaattgcataagacaaatacagactgacaaacacatagcacatatatgatatttctttttttgaatataatggaggaaaacactgtttttagtctagttatcattagacttttgttacagaaaataaacaaattcacccagctctttgtgcatttatggcactgttgcttctcagacaccaaatgaaaatttaacatcctgtgccctcctttttagattaaattctcctgtgttttcttttggaaatgggatggaagtgaaaacaaaatgttgttctaccatatatcaagatgagggctgatattctgtccagagcttaagtaagtagaattgatttgctgaaatgctgaaatgcttgcaactttacacatttttgaaattttctttctgtgggatggaggcagagatcttgacgatgctcgctctctggggcttctgtgtatcaccgggtgaaaatggtctttccttatctggaattccccttcccttcccaccattatgtaaccagctccagcatctccacatggcaaacccttctcaatgcccctgcacacagaatttgtcctttactccttggtctctgcatgtgccccgtgcttctgctgtggcatgtgccacactgtgctttttaacatgtccgtcttgatgatatgctctagattcatctgtgggactgaaccttgtctttgatcactagcgcaccttgtggaaactaatttgcaggcaacagtgttgaactattcatctctattctaattctcatttatttgtggagagaatagaacgggataacttattctgtggttgtgaaaacctgagaattcaactggaatcgagttctcttgtaaaatgtgagtttgagggaagaaacggtgtgcaacttgtatgtgatgatatccccagacaacggtgcatccattatgtatcaggtgctagtctgttttgcattgctgtaaaggagtacctgagcctgggcaatttacaaaggaaagaggtttatttggctcaaggtcttgcaggttatacaggaagcatggtgccagcatctgctcagcttctggtgaggcctcaggaagctttaactcatggtggaaggtgaaggggagcaagagagagaaccagagagatgaggaggtgccagactcttttaaacaaccagatcttgtcagaactgatggagggagaattcactcattaccgtggggagggcaccatgcctttcataggggatctgcccccgtgacccaaacacctcccaccaggccccacctccaacacgggggatcacagttcaacctgagatttggaggggacaaacatccaaactatatcacatcagtaaatatttattaactaatttaagaaaaaaaacaaaaaattgatgtctttatcatatatcttgcttcttcctgtaaaagccatcaaactttccatttaaaaaacccacaatttttagccattttctgatctgtactttcttttaagcttgtgaacatgtccccaagaatgagttcacctttctttcaatgtctttccctttttatattggaaagaaaaggaaagcaaaatgtatgcatgtgcatgtatatgtgtgtgtgtgtgtgtgtgtgtgtgtgtgtgtagtttatcagaaaggaaaagctcaccttccttgatcaccctgagtttgctgcaagctgctgacggcagctaatctgacatttgtctcattgaagtggaagagcagatgtgttgcactggagtcctcttgcaggtcttccgttctgaaggctgcactctgcgtcacagtgtcctagacttgctgcagcccttccagctggtgagctgctttttttcttccagtttaaatacttccttggtgcagcctgagggttggaaggctgggagtgggagagagtttgttctcaaatttatgagctgtgagtgcagggaacttaagtgcggcagctctccagtcgacattacagatatgggtaaaatagtaatctttcctatcaacccacagcccataaaacgaataccttttaatggtgtgggcataattatcagatgtattaagttaattggacagacactgatgcaaggtcttagtagtagccgactgtggctcggtgcatttccttaacattcatagatcatatttcaaatgactgttgctgagagaactcccaaatatattcttggtcaatgtgatttctttctttctttcttttttaaaagctcatcatctccactgagccttaacaatttacattaaaaatgccatttggagcctccccgtcattttccctttagccttactgaaaaatgcttgctttttcacaaggttgcgacacttagaatcaggaccaagggttatggctactaaattccaagttgtcttttatgtacttgcttcaaagcaggcttatattttcttagtatcttttcctagcatatcggccaccaataaaatgaaagagaataatcctgactaaattcatagccatttttacagcatatctgatcatgccttttattgacagagagtaatatgcattaaagtaatctcttgaaagccttttttcaaaaaaaatttgttttggtctttatctttcctttctaagtgtctggaccgtgtataataggaagcataaattccctttccagtgactgctatgttcatgcttctcattttattttattcattctgttttatggactttgcaaagctgacttttggttaaccttatgccctctgaggctaaacttttgatttaaaattatttgaagctctcggctccctgggttgtggagtgcatatagatccatctatggcgttaggtgactcagagctaggaagaacggttacagagtccatgccagcaaccagctgttggcctcacaggtgcaaaggaggcagcactaggtgactgggggttacagtcgcccctggagctcagcgatggtgccagaggattcctcctccaaggtcaacgatgatacagatgtggatgcaatagcatggagcccatttcaaccaccttagcatttggctaagccattcatcaaaggcctcacatcaagccaagcctttctctgtcctccccacactggtctgggcagcagcttcatgcactagggcagtacacccctgtaagctcttcattctctcacctttctaggtgcttgttcctttcatttccctctatccatggggcttctttgtgcttcccttccagactttgcaaccttagtttgacatttattgcaactgtcaccaacattgtagacttccttatctcaacctttgactgtgattgtcatgccactttaggaaaaataccccacttcacttccccatccatattctctgctattgcaccaagcttaagagacttgaaaaagttctagacctaggatgccttggacctgtctcttctctctacctcagtaatacacaatcctgcttcattgcaaagactgacattagctctgaaaactcagttctcccaacttgccctgaaatgtgtatctctaggccttagctttgctctgatcgctatcccctttactaaataaattgatgctctttttatcaatgtgtaccttcatgtccaccctcccttttaatacagtctgtataggtaggaggagcccactgtttgatgtcagaacgtttgagtttgggacctggctcaatttcctgccaattgtgtgacataaattgttgaaaggcaaataagagtatcagtattacatgtgttctcgtaatatttttgtaagtttttttctacctttttattctccctaccagtgctctaggtcaagtttattcatggaaataccagccatgtcttcttaaaatcctgctttgataaaccgctctccccaaattaaactcctaagtgtaatgtttcaagtaataacaaactacttagggaatttatacttcctattatacacgatccagacacttagaaaggaaagatacgaacagcttaaaggaaagatacagtttaactacaaacagcttactgttacttattcaaatatgtattttcagatcttcacttttcctctaaattctctgctctcttcagatcaaatatcttctgaagccaccaaaaaactgtcataacttcccactcccaccaccaaccaccttctccttgcctcttttattccaatatattattcacagcccatgattactaactaactaggtaatattgaccaccaatttcatttaacatctacttgacacaatcatactatctagtgtattgcctcattcatggtctagaagtctgagttgtcttattattatgttgatgactttgtaaccccctggttactgcttaaaaatgcatgcctaaggaagccttcattctctttgccttggtttgctaacacataaaatgaagaacggtgtatttttctactcataggtcttcatgggattttacaagttaattgaagcattctgaaagcttcttgaataaagattaataaagacacatatttaaatatttgatggccagtttcatttttctcattgttactcttattcatattaagctattattatctttttctcagctttgtaaaacaattctggccaggcgcggtggctcacgcctgtaatccaagctctttgggaagccgaggtgggcggatcacgagttcaggagatcgagaccatcctggctaacacggtgaaacgccatctctactaaaaatacaaaaaattagccgggcgcggtggcgggcgcctgtagtcccagctactcgggaggttgaggcaggagaatggcgtgaacccgggaggcggagcttgcagtgagccgagatcgcgccactgcactccagcctgggcgacagagcgagactccgtctcaaaaaaaaaattaaaaaaaaaaccaattcttaaatgaaaggtcgaattgtgacaagtggtcattgtagtacagatggagcaaaagaaacccatgcatgatacgtgattctttcctccacgagtgtttatgtgcgtttcttcaatataggacggaagcaaggaaaaagaaaaggagaaaaggaagcaaaggaaagaaattctacaaagcaaatgtttaagaatctgctaacacattttaatgaagctcattaactcaaacgttgactcaacgtagactatttcacaatagaaccatatatgcccccagaaataatttttttttaatttagagatctaattgtacctttaatactggaagtgagtggaaatagtgttgctgtcgtttctaagtggccccgagaggagaagtaacttgcaggcaagttacaacatccagtttttaaaatttattttaaatttttttcatataaggtgaagatcttttttttattattatactttaagttctagggtacatgtgcacaacgtgcaggtttgttacatatgtatacacgtgccatgttggtgtgctgcacccattaactcgtcatttacattaggtatatctcctaatgctatccctcccccctccctcccatcccacaacaggccccggtgtgtgatgttccccaccctgtgtccaagtgttctcattgttcaattcccacctatgagtgagaacatgcggtgtttggttttttgtccttgcaatactttgctgagaatgatggtttccagtttcatccatgtccctacaaaggacatgaactcgtcattttttatggctgcatagtattccatggtgtatatgtgccacattttcttaatccagtctatcattgctggacatttgggttggtttcaagtctttgctattgtgaatagtgccacaataaacatatgtgtgcatgtgtctttatagcagcatgatttataatcctttgggtatatacccagtaatgggatggctgggtcaaatggtatttttagttctagatccttgaggaatcaccacactgtcttccacaatggttgaactagtttacagtcccaccaacagtgtaaaagtgttcccatttctccacatcctctccagcacctgttgtttcctgactttttaatgatcaccattctaactgatgtgagatggtatctcattgtggttttgatttgcatttctctgatggccagtgatgatgaacattttttcatgtgtctgttggctgcataaatgtcttcttttgagaagtgtctgttcatatccttgggccacttgttgatggggttgtttcatttcttcttgtaaattagtttaagttctttatagattctggatattagccctttgtcagatgggtagattgcaaaaattttctcccattctgtaggttgtctgttcactctgatgatagttgcagaagctctttaatttaattagatcctatttgtctattttggcttttgttgccattgcttttggtgttttagtcatggagtcctgaatggtaaagcctaggtcttgaatggtattgcctagttttcttctggggcttttatggttttaggtctaacatttaagtctttaatccatcttgaattaatttttgtataagatgtaaggaagtgatccagtttcagctttgtacatatggctagccagttttcccagcaccatttattaaatagggaatcctttccccatttctgtttttgtcaggtttgtcagagatcagatggttgtagatgtgtggtattatttctgagggctctgttctgttccattggtctatatctctgttttggtaccagtaccatggtgttttggttactgtagtcttgtagtctagtttgaagtgaggtagcataatgcctccagctttgttcttttggcttaggattgatttggcaatgcgggctcttttttggttccatatgaactttaaagtagttttttccaattctgtgaagacagtcattggtagcttgatggggatggcattgaatctatcagttaacaaggtgaagatcttttctgtgtctgccaataagttttcttcatctagtgactgtaaaggagtttgacaattctcataaattgaaaagttattgggagatacaaagttacatataaatttcaaattgaaggcccatcaataggattatgtttgtttaaatacaaacagcttcagctttccaagactttctactctggctcttgtgttaattgtactaatggctggtactgtgtgacttcttcatctctttggttctctggttccttctggaggtaaagttctatgattctattcatagcagttcctagtctgattaggttaccaacatggataagaatctgataaaagttataaactgtattttcagtgaaaagcacaatttcctaaaacatatgtgtgtgtgtgatatggtttggctgtgtccccacccaaatctcctcttgaattgcaactcccacaatttctatgtgtccctgggaggaatctggtaggaagtaatagaatcatgggggtggatcttttcttggctgttcttgtgatagtgaataaatctcatgagatctgatggttttaaaaatgagagtttgcctgcacaagctctctctttgcctgccaccattcacgtaagatgtgacttggtcctccttgctttccaccatgattgtgaggcatccccagccatgtggaactgttaagtccaataaacctctttcatttgtaaatttcccagtcttggctatgtctttattagcagtgtgaaaacagactaatatagtaaattggtaccagtagagtgggtgctgctgaaaagatacctgaaaatgtggaggcaactttggaattgggtaacaggcagaggctgaaacagtttggagggctcagaagaagacaggaaaatgtggaagagtttggaactccctagagacttgttgaatggctttgaacatgatgctgataataatatggacaatgaaatctaggctgaggtggtctcagatggagatgaggaactttttgggaactggagcaaaggtgacacttgttatattttagcaaagagactggcagcattttgcccttgccctagagatttgtagaactttgaacttgagagtatctggcagaaggaatttctaagcagcaaagcatgtaagagatgacttgggtgctgttgaaagcattcagttttataagggaagcagagcataaaagtttggaaattttgcagcttgacaatgcaatagaaaagaaaatcccattttctgaggagaaattcaagccatctgcagaaatttgggtaagtaaccaggagccaaatgttaatcaccaagacaatggggaaaatgtctccagggtatgtcagaggtcttcatggcagccccttccatcacacccttgaagacctaggaggaaaaagtggtttcctgggccaggcccagggtctccatgctgtgtgcagcctagggacttggtgccctgcatcccaggcactccagccatggctgagaggggccaacgtagagcttgtgctgtgacttcagagggtgggagccccaagccttggcagtttccacatggtgttgagcctgcaagtgcacggaaattaagaattggggtttggaaacctccatctagatttcagaagatgtatggaaatgcctggatgtccaggcagaagtttgctgcaggggcagggccctcatggagaacctctgctaggacaatgcagaagggaaatgtggggttggagccccacacagagtccctactggggcaccacctagtggagctgtgagaagagggccatcatcctctggaccccagaatggtagatccactgacagcttgcactgtgcatctggaaaagctgcagacttccaatgccagcccatgaaagcagccaggaggtaggctatgccctgcaaagccacaggggtggagcttcccaagactaggtgaacccaccttttgcctcagcatgacctgggtgtgagacatggagtcaaagggggtcattttggagctttctgatttcacatccctgctggatttcagacttgcgtggggccaatggctcctttgttttggccaatttctcccatttggaatggctgttatttacccaatgactgtacccccattgtatctaggaagtaactaacttgcttttgattttacaggctcacaggtgaaagggacttgccttctctcagatgagactttggactgtggacttttgagttaatgctgaaatgagttaagactttgggggactgttgggaaggcatgatgggttttgaaatgtgaggacatgagatttgggaggggtcggggcctaatgatatgatttgtctgtgtccccacccaaatctcatcttgaattgtaactcccacaattcacatgtgtcattggaggaacctggtgggaggtaattgaatcatgggggctggtctttcctgtgctgttctcatgatagtgaataagtctcacgagatctgatgactttaaaaatgggagtttgactgcacaagctctctctttgcctgccaccatccatgtatgatgtggtttgccttctgccatgattgtgaggcatccccagccatgtggaactgtgagtccaataaacctctcttgtttgtaaattacccagttgtgggtattctttatcagcagcatgaaaacagactaatacaactaataatatataatatattatatataattatatttacattattacattaattatataaaattatattttccataattttattacattatatacattacatatatatttacattgtatatctattttcttttaagctgctcagtgtcaaactcattgcatgagttttagggacaatcaatcctcagcaccagcatggaacccagaatcggcagaggccaatttgcagtctgtgacctgcacagatagaatgctggcacgtggcttcatcctgcttagtcccaggtcttgaaaccagagttagtgttgcaaagaagtcggcacagcttagcatttattctccaggcatgagctggagcagcattcaaggttctaggccagcaacagctgtttccagtggtgaaatgccgtgtccgatagcagaggagtcttaaccagtcttgcctgtggtatcgttttcattattgttttgaatcgctggcctcccttggttttataactgatttctgggatacgtaatatatttccagtaaattcagtgaactatccaatgtattgttaaattcctttctcacatgaattcaccagaattagtttttgctgtttgcaaagaagaactctaacacacataaaggtaaggaaaacattccgcctatagcttcagtgtttcagtgttttgatgagccccttcagcccatcacagattctgcttgcctctctcaagctgatggggttggtggttttctgggctgtgagggtgagagagtatctgcaaggcctgtgtaaggacacctgctctaaaaaggcgtgaactggttgggcgcggtggctcacacctgtaatcccagcaatttgggaggccaaggcgggcagatcacttgaggtcaggagttcgagaccagcctggccaacatggtgaaaccctgtctctactaaaaatataaaaattagccgagtgcggtggtgggcacctgtaatcccaactacttgggaggctgaggcaggagaatcgcttgaacccaggaggtggatcttgcagtgagccaagatcgcgccactgcactccagcctgggtgacagagagagagagagactctgtttcaaaaaaaaaaaaaaaggtgtgaatctaattagttgtttaaaaaactaggtggtgcaaagcctcgattttctgatcgtgctaatacaaggtaaaagtcatgagctggtgcatatcaattctagaaagtgaaatttaattaaaaggataaaattttaatctcaattatttactttattttttcaaatttatttgcttctgtttttttttttaattattatttttaagatgaggtctcactctctatcacccagctggagtgcagaggcattatctcagcttactgcagcctcgacctcctgggctcaagccattcttccaccctagcctcccaggtagctgggactacaggtgcacaccaccatagctggttaatttttgtatttttaatagagctgaggtttcaccatgttgcctaggctagtctcaaacttctgagctcaagccatcttcctgcctcagcctcccaaaatgctgggatgacaagcatgggccactgtactcagcccaattagttactttaaaacttgctcttttcctcttatttttcaactaatgaacagggcaaatctctgtctccactacaaagtcaatccagcagcgtgcctgagaaactcctcttctattgtctgcgagggcttgcatatgagctttcaattcatctgaaatagcaattcccctactgtgagtgttttcataaagactttcagagcagaaatacagagtgctttactatgttagtgtttccacctagtatctgccacaaagacaagttataaaaatcagcttcagaatgtttaggaagtaacagagagcctccagttgagtgtctacattaacaaataacgcacctcctacatacatgcatggccagttacacgcaaacattgaatagattttgttaaaatatcaatgactgacacttaggctaagacgatgaatggccaaccagtgaaatagtgtgtgtgtatatgtgcctgtgtgtgtgtgtgtgtgtgtgtgtgtgtgtgtgtgtgtgtgtgtgttaagagagaaaactcttttcctccaaggtcattaaggtcttttttcaaggtcacgaagttctagtagaacttataacacacttcagaggcaatcattattactaaaattttaaacagaaagaaactacaagcaatgggaagaagaagaagaagtgagtagggcaggttatatgctttcagaaaatacagataaagggaagacaaatcccagttttcttgaagctcgtttttattttttttatttttttgagatagggtctttccctgttgcccaggctggattgagatggcgtctctccctgttgcccaggctggagagcagtggcacaatcttggctcactgcaacatctgcctcccaggctcaggtgatcctccgacctcagcctctcaagtagctgggattacaggcatgcaccaccacacctggctaatttttgtatttttctgtagaagcagagtcttcctgtgttgcccaagctgttgaactccttttatgctttctcttgttttgattatataatctctttctagacagttcaaataaagtttgaaagtaggtttttcttttcttctttagaagccaatttcctttgaaacatggagacaaaacgctatgtcgtttatttattaagatctgttgttttccctcatcttttgtagtagctaaccacagtatcacctctcccgtatttactatactctttgcctgtagccagcaaagtaacatccacagaggcagtgagagaatgcttcttatgtgagtcttagaattatttattctggatagaatttgtttttaatgtttatggaagtgtccaaagtagaatctattccccaggtaggcattaggtacagcagaaaagacacttccactcaggcaggtgctgaaagataatctccgtgacaaagtgattctccatgagaattgagtctttagtttctctgctgtcaggggagttgttgatggccatttacactttttgtataatgaggacacctgtttgctaataattgaactgaggatatcacaacacagggcgtttaaaaataacatgggaatacaattgcagattacatacacacatgaatagatgtttgctgttggtagcttaatgggccatggctacgtatttcctaagtagctaaatcgagttacagattttgtagtatttattgcatttcattttaataagcagttattatagttgaataattacttcatcacaggtgtaacagataccacaggggtgacatcagtgaaagtgctttatcactgcttttcctgtgccatggggtaataatcaaagacagagcttaaaagaaataaaaagttcccttagtgaagcagattgagatttcattttcagtgcgacccagtatgcttgattgctacatgaataaactggtgtaggctagaaaccatacctctatggaagtgaattgtgttgaatgagggactaaagggaagaagatcacctgaatctggggaccctgttgctcctggagtagtgcagcattgggatatgtttttcctctagctggttggcatataccatatagagaggttggcatataccgtatagagaggttggcatactgtatagagaggttggcctaccttatagagaggttggcatataccatatagagaggttggcatataccatatagagaggttgggataccgtatagagaggttggcataccgtatagagaggttggcatatactgtatagagaggttggcataccgtatagagaggttggcataccatatagagaaggcaaatgctttgttccacctgaatttgtgactgtggtgcagaggatttcatggctaaaaatagaaaacttctcacgttactataggtctaaatggaggtaatattttaaagactaaaatcgatgttgataattacagtagtttatgttatatcaaaacatcaaaaataaaagtaaccgaataatcaaaggacctaacacccaaattaccaactgcctttgatctatatatactatatataatatatgatctatatatattatatataatatatattatttttttcttagaagcaattggcagaatcatggaatattacaaacattaaaacttatagagggctttaagaatcactttatttatcctcctatttttgtaattaaaaaataaggccagagtgttgtattgacttggccagtttccatagttaatactgagggataacacttccttaaagtataatagtgatatttgcacacaacaatctttctacttctctactttaaaacttcctatttaacttcagttcactctgaaaaaaatgaattttggcttgctctcaattttacctctttatttaccaaaatagagggtatctgtatcactatgtcaggtaaaaatctaaatttttggaattcatctaccattagtgtatatattctaaccttcattacttgcaggtaaaaatgtgatcatgctaacagcgacacccaaatctacttatctccaaatctccaggcggcaactcaggccagatcctttcccaggtaatctcaggaatccccgaagtggcaatgacttcctcaggaatacggcttttaattttctttctttccctcaaattcttcttggaggtctattgcccctaagccctaagctgctgctttaagctgctgctgtcgtattagatggtgaagtagagaggctacctgtggcttctccctgtggttacttgggtcccagcacagtgcttcttaagctcagagtctcaaagcattttcatgagcttttactgaatccttgagatgcagtattcagataccatctaatacctcccatttttctactcttgccttttactccttcctagtccccaaaagcctcttcgtttttcaaaaaataataaaaggcagtcacagaggatagtcgcagaggagggctgttgttcatttgccaccttggaaaaagcattcatgttccatctttgcccagccaagataaccttttaggaatattttgacatgcattttactttctgggaactggcaccaaagattggtcatcattactctaattaatcgcttctatttgtaagggtgatgaggttttgtacggattggccaaaatagtcaccattaagaaatgctttctctgttcagctaaaaccctatgtctgaagccacacaggaacggatagctttagtctgtggttctaatgcctcattttctataaattccaaatggacctgcctttttctgggccagtgacacggaaaatgatagttggcagtcgatggtcattaaaaaaccttcttggaatgctgttacagcagtgggcagccgttactgtcatgttgagagtgataaaggtagaatcatgggatttcaaaaatcaaagggaacttagaaataattttgttcaactcccttgtcttatagataaaagtagtcatgtaactatctgtcattttatacccaatttaaaagcttgtgacatccttctacaaaatgaaaacatacaatcaaaccaggcactcttgcttgccaaggtcctacatttgggcctcacatgctcattccatttaaccattgcactggcgaatgcagcagtaattcccagccatgacggacaaaaatcccaggtgcatttttgactctagtcatgaagtcattgacacaacctcaaaaataattaacattttcatagacaattccacaaaatactttcaccacagggaatatttttcagcaaaagatgatggttaggtagatatagcagcttcccaaatagtgggattcttagagcacggataaaatcagttgaaagctgaaaaaatatcttgaatgggcaaggaagaaggaatccaatgtaggaaagcttactttatatttccatggataaatgcaataacacttacgtttctgaaaattctatcagcatgccaacttcatttccagtccaacggattgccttattgccctgaatcatgttaagccagtcttggaacttcgtggctcccagtggatctccagctccttactgttcctgagagccatctgttgtgtgtaggtttccactggacccggcataaatatttacatgtgagttcatcttgaggtgggattatgcctaataaacccctggaattctgtaccaccccacgcatggttactaattttatctttctctggtatgtttagctgaagctggcacattgttcttttttttttctaatcaattaaaattttaaaaatggtgatcaaagcactggtggtcagtgagagcctagacagtaagagctctttcctcaggggttgaaaaatctctatctaaacaaataaagtggtcatatggtttgaaaatatttatagaggggccggccatggtggctcacgcctgtaatcccagaacttcgggaggccaaggctggcagattgcttgaggccaggagtttgagaccagcctggccaaaatggtgaacccccatctttactaaaaatacaaaaattagccaagtgtggtggcgcatgcttgtagtctcagctactctggaggctgaggcactagtatagcttgaactcgggagatggcggttgcagtgagccgcggtcacccccgcactccagcctgggcgacagagcaagactctgtctcaaaaaaatgtatatatctatatatactgccgggcatggtgactcatgtctgtaatgccagcactttgggaggccaaggtgggtggttcacttgaggtcaggagctcgagaccagcctgaccaatatggcgaaaccccatctccactaaaaaatacaaaattagctgggcgtggtggtgcaagcctgtaatcccagcaactctggaggctgaggcaggagaattgcttgaactcgggaggtggtgaactgagtgaactgagattacgccactgcactccagcctgggcaacaagagcaaaactctgtctcaaaaaaaaaaaaagaaattatgtaatactttttccatgagtcaaattcaaatgatggcgatccactggcgtgattgtaatgacacagtttaatcaaaggccgtcaaggtacgtacaattgactagaaccaacttgatcatagttaactgaagaatgttgtggtggctgtgttctttgtcttccgaagttgacttatgaaatcaaaacagtattctcctggacatatttaataatgcattcaagcaggcattttgccaaatccctttgagaccatattaaatggaaagatattttaagcattcattttgatgaatggagcataggtaaagaccttgttcaatccacagggtctagtatacaatgaaagcattgaccaacagataatttattacagtgcggtggaattaatttttggtacattgaatatttattttcctcagtgtgttttaaatttcagttttagaaaatttttgtgtgattatgaaattaatacatgttcagtgtagaaaattaggagaatatagaagaaaagataagggaaaaatcaaaagaaaatccaattctcaaaaatacccactatttttattttggtataaatatgcatacaattaatattttatcactcttgtcaatcatttcaaagatgttattcaaagatatttctacaatgttatttgcagttgaataatctaaatgaccatcaacaggactttgatgtactggcatgaaaagaggttgacaagaacctgtcaagggaaaaaagcaagaactagaaaacttttataataaagcctcatttttttgtatcaaaaattttagaagtcatgtagaaaagtgtttctatattaacagtgtttacctctgaggaagctgataaacagagcaggtttttttttataaccagtattcattttgtaataaataaataaacaactctagcttatgcttgctttgttagaacacagcaatccatggcatatgcagattgggtcctggtcctgtgactattaagaattatttacagatttaattttcccatttgaagataattgtgaatcaatgcaaagattccaagagaaaaaaaggtgcagctaaattattaacaggtaaaacactgtatctgagtggaaaggtaaaggagtgtagattacttgttgaaagtaggatatttgggaacaatctaacaacaaatatgtattgactggctactctgtataatgccccacttggatggtactgaacagaaatcctagatccacagaaaattgtaaaaggtgcctataattaggtgtcaggatttgccgctgatctggaaggccgacctctgaatacatacagagaagagtaactggtctatatgtgagctgaggtgatatttaaaacatggaacgccctggacagcacaggtgtggaccaatcagaagggatactggctgtggtcctggggtagagtcctggagggtctattcataccaggcttaaattaacttttcggttgctacacaggggtgagcagggggtcacagggcaaaggcctgggttgggggcagctcagtgagctatactctaaatcctgataagaattctaggaggtaggtgcaactcttcaggatgagtgtttgtagtacttgttgctactattatttgcctcttctagaacacgggtccgcaacccccaggccatgaaccagtgtgggaaccaggcagcatgcaggaagtgattggcagatgagcaagcaaagcttcatctgtataacagctgctccccatccttcgcactgcgcctgggctctgcctctggtcagagcagaagcagcatcagattctcagaggagcacaaaacctattgtgaactgcagatgtgagggatctaagttgcatgctccttatgagaatctaatgcctgatgatctgtcactgtctccccacaacacccgtccatggaaacattgtcttccatgaaactgattcctggtgccaaaaaggttgtggattgctgttctagaaaatatcatgagagtttacttacgaaacgtgttaaattaaaagactatatattaaatgaaaacatttgtagatttcagtcatttaaattgctgttttctccttaggctgtttgcccctctctatctcccggtcatgtcagtacctttgtacctgttctttcacatcaaatggaatggctgagttagatgtctttcatttcagccctcttgacaccataaccatgtccttttttctgaagctactattatttccagaagttagtatttccttagatgataaaatagcaatagtaacttcaacaatatggtaaatttagagttgtcctctggggctagagatgaattttgttattgtaacttttaactttaagaatacctgaacatttttagttaatttaaaccaccaaaaattcaattaacaatggatatgtttataagtaagctatagaccatggtgggcccttcctagtaacatcttactttacatgtaacaattctcttgagatgcagtatttcatctacttattgtgacaatctttcaaagaaggcaatatcgttcaaattttgtaaacaaggaaacagagggttagagaaatcaaactgcttgtcttaaagtacacagctataagcagcatcatcagagccaaaattctgtgattttttttttttttggctataaatctaatgttttttctactactttccactgccctgtttttgttttcttatgttttagtgttgactacaaataacagttatagctagtttggttttaagggacacaatgtttgaaaggcctttatcaatttttaaaatactttgtctttcagaatgtaataaaaaactcccaattacataaatgttgattcgctaggttctataacattgaatcatagtctcgaatggcaaaaatgaattaacacagtttaattcccccattttacatctcattttcatcgagaaacttgaaatgtgtaatgtggttcaaattccttgatgcatttaacagcccattgggttttgtgtgtccaataactgccaccacccctcaacctacagaagcagataccttgtgaattataaatttgtgcataatggaagccaattgccacatgttcatttggattttaataattcagggataatctgctacaggtagagtgggacagatcccccttacgtggcaaaattggaaaaaaggtagacaaacaattaataatgaagggttgaaattagcatctaccaatgtcattaatgctttgtcattcttacctggatttcctttaggtaaaggcaaggatttatctattttctttctactaacagtaagacatagtctcttttgcagtatcttgtatatctaaagaatctaaaatgtcagttagaacataaaatgctttggactgtagatgtccttacttggtgtttgtgctgggctaaataatacacctccaaggatgtccacgttctaatcccaggaacttgtgaaccttaccttatgtgtcaaaagggaccttgctgatatctcactatgggaagatgacctgattgtcctggtgggctctaagcatcatcgcgagacccttgtgagagggaggcggaggcagaagtgacctcagaagagggtgacgtggtggcagagagacaggctatgctgccggctttgaagacggaaaaggagacacctgccaaggagtgcagcagcttctacgggtgggaaaaggcaggaaaacagttctccagagcctcggaaggaacccgtcctgctgacactttgccttcagccttgtgagactgattttggatttctgacctccagaacattaagacagtaaattagcactgttttaagcaatggaatttgtggcaatttactacagcagcaataggaaactaacacaagcagtggtaaagcccattctggacttagctctcctctcccctgataagacctctatgctgtgtgcctcttagagatttccccatggtgtctttgtttctggacattgcaaccccataattcagagaggtaatcatagaaaggcatgtggataagaaccaggcattggttctgggtcttgatgaaaatctttctctgttaaaacaacatcgagacactaccatacacctatcagaatgatgaaaatccagagcactgacgccaccaattgctggcaaaggtgtgaagcaacaggaactgtcatccgttgctggtgggaatgcagaatggcacagccactttggaagacagtttggcagcctcttctgaagcaaaacatgcttttacgataggagcctgaaattgctttccttggtattcacccaaatgagctgaaaatacatgtccacacaaaaatctgcaagtacatgcttatagcagctttactgataattgcccaaacttggaagcaacaaagatgtccagtaggtgaatgcgtcaataaattgtggtacatccagacaatggaatatttttaaagtgctaaaaaaaaaatgagccatcaaaccatgagaagacacagaagaaccttaaatgcatattactaagtaaataaaagaatccaatctgaaaagggtacatactgtacaactgaactctatgacactctggaaaagacacagcttggggacaatgaaaagataatggttgccagggtttttggggagggagggaggaataagcagaaaacaggatttttaggacggtggaactatttcgtaggatggtacagtggtgcacacgttgttatatatttgtcaaaacccgtagaatgtgcaacactgagagcaaaccctaatggaacgtggactctgggtgatggtgatatgacattgcaggtgcatcagttgtaacaaatgtcccactcgaataatggatgttgagagtggggtggctgtgtgtgcgggggtgggtgggggcttgtgggaaatctctgtatgttctgatcaattttgctgtaagcttaaaacttctctttaaagaagagtgtatttaccagtaaacatttacatatatatatatatgagatatacatatatctatatatatttaacttagagcctctggcaggggacagcaaccaaggatccatgtgtctggttggctctagggaagcctgaccttcacagttagacttgggggttcccctgggaatacacagtgggcagccacctttccaaaggatgggatgaccaggccggattttggtacctcttctctccccgtcaccctgcttcacaggatgagggaatggacagatgaacagataaaccaagaagagacaccacattctctggcagaggagctctacaaagtgcagtaaattcctgggatcatatgagtgatgaagcccagaaattgcccagggaaggaagttagcaaacttaagagtaagtcctttggcccaattttaacggacaaggtaaaaagaatagttggtgtaacatctgaagtttggaaacacatgctttgtttaccccccgccgcatcctcaggcctttcaaaatgagaggatgcccactgtgagccagccgctctcttggcaagccggctggccacaaagaggctcagtcataatcgggtggaaacatacactctcccctttttattggcggcttgaggcttggtgattggcctataaatctaaactgcaagcgcagagcctgtgtttggggtcgtgatccgtttgccacaggcacactggtcctggctcgatttaccggccgttctgcctccgccctttgaactgtaacccatttgaagggctctgggggtgactttgctgtgcctcaatgatttatagaaatttcaggattcaaggttttcacctttgatgcacaattctccttttccttggaaaggggaccgggaacaaactaaactgacacagtatccaagcaccatccatttttgaacctttcaaactgtgcccagtcagttcgtaatgctttaggatgcgttctttcttaacaggctccttggctgtttgttcaaatcaacctcggagaggctttctcctcagttccgtgcatcttccttcactgaaacaaagtgtttacatcctacttggttgaatttttttccaggacgactctcagcccgatggctatagacttctcttgggctctgacatcggcttaccaggtttgactagaaatacacacgttccaaccataggcacagagaggacacagtttatgatcaagttagagttttattgcatatataggaaagacaaatgcacaaaaaggactggaagcagcagctcctgccatgagtgctgaatttgatgtatgattaaggcagctcacgggcatggggtgctgtgggatcctgagaagaagggctctgaagcgcaagggggacacttctatgtaatctgcactcacgctgttttttcactcagtgccctgcttcttggcactggctgaatctccatctcctatcacacatctcctgccccttggtggagagagggggtgagcaggtgagagaaggcacaggagaaggggaatgaaggtggaaggacatctcaggaaagtcccttttataatataaagtgcaggcaattcaggttgtacccacactagagatgccagggataccctctctgtggttctttgggtcctgggggtttggaattattgccagtgattatcagtcaatatgtgccatgaactttgtcatcatttatagactgaataaatgatatatgtcatttatttgtgctactgcttttaaaatataacaaaatagaaatttatttttaaatgctaataagttcatatgaatgtattatttttttgtttttcatctgtccttaatataccataataaaagtaataatagtaccatgatgtgaacatctggaagaaaagaagattttttgtttctcaaattttgtaaaaataggagtagataaattctgacatcttagaaggaccaaatgttttgttggataagtggtactataacttccccaaatacaatagatattttatccacacaatatacactttcattggatggatttggtttattcacaaacatgtgcaactaggaattagcctattttatttctttgaaagttagttgttaatcatccataggtatgtttttaaaaattaaaacataaacatgcctttccttttagaaaaacagtatatatatagtatacaagtaaatacagtatacaagtaaattatctacatatacataaatgtatatgtatatgcaaaagagagagataaatttcacaattctaccactcaagataattgctatcaatatctaggtgtatatccttctagaacttttaaaatagacacgtttatatacattatttacaaaacacaatatctcattttaggctatgtttaaaacctgttgtcttttccatttaccaatttaggattattgtctttccatgagaagacgtgttgttgaagcttggaattccctactaactcattttcaaaggaatctgtgattgaggtaaatccagttttctagagagaaagaggaaatgtcttttgaagccatgcctgggaagtatgatcagcgaatgttactgcacagatttttttccatcacagcttcctcccatctaaataattatgatttcttcccttatgccacttgttattccacgctttttattcattgtctgtgattaaagcctctttaattaggagctagagaattcactctctaattgaggactcatttaaaattcatgggcctggacttaggattctggtctttcactgcttcggtccatgtactagggtgcctatagcaacacacagcttcctatttctaaggttctttcaattctatttaaaaagaccctaaggagtacagacatcaaatagaactctagtatttggaagaatttagtttaaatgagatagaaccatgcaaactaaatttttgtcaataaaaacataagcttgcgcctaggggtttgagcactggggcaccagtgaagtgggccatccccctgtcacatgtcctgcgaggaggataagggaattctctggttttaacttaatctgtaaaagaccttgctaagaggatgaaaaagaagccacagcaatggataaaacatttgtaaactacatatccaacaaaggaatattatgactgtttcaagatttgcagaactgaataggaacagctccggtctacagctcccagcgtgagcgacacagaagacaggtgagttctgcatttccatctgacgtaccgggttcatctcactagggagtgccagacagtgggcgcaggtcagtgggtgcgcgcaccgtgtgcgagccgaagcagggcgaggcattgcttcactcgggaagcgcaaggggtcagggagttccctttcctagttaaagaaaggggtgacagacggcacctggaaaatcgggtcactcccacccgaatactgcgcttttccgacgggcttaaaaaatgtcgcaccaggagattatatcccgcacctggctcggagggtcctacgcccatggagtctcactgattgctagcacagcagtctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctttgcaggcaggccacagacaaacaaaaagacagcagtaacctctgcagacttaaatgtccctgtctgacagctttgaggagagcagtggttctcccagcatgcagctggagatctgagaacgggcagactgcctcctcaagtgggtccctgagccctgacccctgagcagcctaactgggaggcaccccccagtaggggcagactgacacttcacacggctgggtactcctctgagacaaaacttccagaggaacgatcagacagcagcattcacagttcacgaaaaaccgctgttctgcaaacaccgctgctgatacccaggcaaacggtctggagtggacctctagcaaactccaaaagtcctccagctgagggtcctgtctgttagaaggaaaactaacaaacagaaaggacatctacaccaaaaacccatctgtacatcaccatcatcaaagaccaaaagtagagaaaaccacaaagatggcgaaaaaacagagcagaaaaactggaaactctaaaaaacagagcacctctcctcctccaaaggaacgcagttcctcaccagcaatggaacaaagctggacggagaatgactttgacgagttgagagaagaaggcttcagacgatcaaactacgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgaagaatgcaggagcctcaggagccgatgcaatcaactggaagaaagggtatcagcgatggaagatgaaatgaatgaaatgaagcgagaagggaagtttagagaaaaaagaaaaagaaatgaacaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatacagagaacaccacaaagatactcctcgagaagagcatctccaagacacataattgtcagattcaccaaagttgaaatgaaggaaaaaatgttaagggcagccagagagaaaggtcgggttacccacaaagggaagcccatcagactaacagtggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagatattttgtcaccatcaggcctgccctaaaagagctcctgaagaaagcactaaacatggaaaggaacaaccggtaccagccgctgcaaaatcatgccaaaatgtaaagaccatcgagactaggaagaaactgcatcaactaatgagcaaaatcaccagctaacatcataatgagaggatcaaattcacacataacaatattaactttaaatgtaagtggactaaatgctcccattaaaagacacagactggcaaattggataaagagtcaagacccaacagtgtgctgtattcaggaaacccatctcacatgcagaggcacacataggctcaaaataaaaggatggaggaagatctaccaagcaaatggaaaacaaaaaaaggcaagggttgcaatcctagtctatgataaaacagactttaaaccaacaaagatcaaaagagacaaagaaggccattacataatggtaaagggatcaattcaataagaagagctaactatcctaaatatatatgcacccaatgcaggagcaccaagattcataaagcaagtcctgagtgacctacaaagagacttagactcccacacattaataatgggagactttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaaactcactcaaaaccgctcaactacatggaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaagtagagacacaaaaaacccttcaaaaaattaataaatccaggagctggttttttgaaaggatcaacaaaattgatagaccactagcaagactaataaagaaaaaaagagagaagaatcaaatagacgcaataaaaattgataaaggggatatcaccaccaatcccacagaaatacaaactaccgtaagagattactacaaacacctctatggaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaagaccagatggattcacagccgaattctaccagaggtacaaggaggaactggtaccattccttctgaaactattccaatcaatagaaaaagagggaatcctctctaactcattttttgaggccagcatcatcctgataccaaaaccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctgtgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcagaagacagggatgccctctctcaccactcctattcaacatagtgttggaagttctggccagggcaattaggcagaagaaggaaataaagggtattcaattaggaaaagaggaagtcaaattgtccctttttgcagacgacatgattgtatatctagaaaaccccactgtctcagcccaaaatctccttaagctgataagcaacttcagcgaagtctcaggacacaaaatcaatgtacaaaaatcacaagcattcttatacaccaacaacagacaaacagagagccaaatcatgagtgaactcccattcacaactgcttcaaagagaataaaatacctaggaatccaccttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatgatactggtaccaaaacagagatatagattaatggaacagaacagagccctcagaaataacgccatatatctacaactatctgatctttgacaaacctgagaaaaacaagcaatggggaaaggattccctatttaataaatggtgctgggaaaactggctagccatatgtagaaagctgaaactggatcctttccttacaccttatacaaaaatcaattcaagatggattaaagacttaaacgttagacctaaaaccataaaaaccctagaagaaaacctaggcattaccattcaggacataggcacaggcaaggacttcatgtctaaaaaccaaaagcaatggcaacaaaagccaaaattgacaaatgggatctaattaaactaaagagcttctgcacagcaaaagaaactaacatcagagtgaacaggcaacccacaaaatgggagaaaattttcacaacctactcatctgacaaagggctaatatccagaatctacaatgaactcaaacaaatttacaggaaaaaaaacaaacaaccccatcaaaaagttggcgaaggatatgaacagacacttctcagaagaagacatttatgcagccaaaaaacacatgaaaaaatgctcaccatcactggccatcagagaaatgcaaatcaaaacaacaatgagatgtcatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagtcttggaaccaagccaaatgtccatcaatgatagactggattaagaaaatgtggcacatatacaccatggaatcctatgcagccataaaaaatgatgagttcatgtcctttgtagcgacatggatgaaattggaaatcatcattctcagtaaactattgcaagaacaaaaaactaaacaccgcatattctcactcataggtgaaaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataataatttaaaaaaaaagatttgcagaactgtctatttaacccatagactcatgagcaataataaattattattgctttaaccagtggaaaacaaaacaaaacaaaacataagcttgcaaattttatattctgtaatatttccatgggctatataaccgcaggaagggcaaactatatctttatagaataaattgtagactggaagagtaatgaaaaaaactgagaggagtgtaacaaaataattaaaggcttagaaaacaatatccatggagcaactaacagaatcgtattcatcgcctttggtgaaatggctgttagtgattacaaaccgtgattacaaaggaagacatgttctatattggggagtgacaagctgttaactgatgcagaaaaatcacaaaacaagacctgaaagctttaaaagaaatacttatctaatatccctaaatgagggtttcctttttttcttttgagatggagtcttgctctgtcacccaggctggagtgcagtggcgcgatcacggctcactgcaagctccgcctcccaggttcatgccattctcctgcctcagccccccaagtgtctgggattacaggtgcacagcaccacacctggctaatttttttgtatttttagtagagacagggtttcaccgtgttagccaggatggtctcgatctcctgacctcgtgatccacccgcctcggcctcccaaagtgctgggattacaggcgtgagccaccgcacccggcctaaatggggattttcaaaaagccaaagtcatttataagaaaggcagtgaatttgaatgaaaaatacattgaaccagttggaagtcagaaggtctgagttctctgtggacactgccgctgcctcacttgtgatccttcatgcatcctgttgcctccgcagatgagcgtttactcatcttcatagtgaaatagcggactaagagatcaccactactccatcagcatgacgtgcatcgtcatggtgagatccttcctacccagtatggcagggcctctgccagttgctttctccagcatatttctttccattccttcttagaaacaaatcctgataccttcagctgggcatttttcctggaataaaagacgacacttctgagttttcttgtggcatagtgtggtcatgtagctatggtctggtaagtgagatggaagcagacaagttgcataggactcttcggaaggtgacttaaagggagcttactcagcttcaggggtgcctttttgtcttactttttctccgttaggcccaaaagtcagatgtcctggcttaagctgctgaagccaccttggaccatgagtgatcttgagaatggaagccactgtctagatgttggaacaaagacaatggcctgggcctccctgatgacaccgcagagtcaccgtatgtgtcctggagtacttgctctctgcttctttttcatgagagataagtacatttttatcttctttaggccactgctatatttttcccgttaaacacagctatatccaatcctaactggttcaacctataaaatgtgattatttcttgttttaagataactatagctaccaattattttgcacttagtagctgccagacactgtactaagtgttttatgggtgtcaccttatctaatttgcacaacaagaatacttacaaggtaggtattattatctataatttacaaatgagaaaatggaggcttagaaagcttacatagtatctacagggtcatattgaaaaaagcagagttctaaaccaggttgggatgaccccaaaacttgttctaatcttaatcactgttatcagtgtaatgcagttattatcctctgtgggtaaaagatgctattcctgattcactcacggcaatacgaaatatacaaggagcacagtgttggctaatatttctagagactcttacggaattgtcaagatgtagacaactttatgtccaatctgctccctgaacaagattgacaacaaagacccggcttgccttctgtatcacagatgacaactatccccaaaccttacctaggttgtcaaacattcacctttataagagatttgcaaacagaaataacactgactgcaaaactgatggcggggattaaataagaggatatatgtaaaatgcatagaagaaaatcaggtacacagtaaatgcttgatgaatggtacctgacggcaccattatttaagggatccacagtgagactgtgaaaattttcaggagtcagaaatattaggttcaaccacaacctctgcaacttgctagttatgtgaacattgttcagtcatttaactttttggcttctaattttctgaggaatacattatttatataacagaactgtaattggggataaagcctttccagtccccatcccagtgcctgacgcattttagaatcccagccaatgaaattcttctcactattattctcacagaattctaatgaacatactaccaacagtgattttctccttggcccattaaccacacggaagggagtattcgctgtggagtgcctctgtagctgagggcccctggcgcgtggtttcatcagaggcagacagctgcgtgagtcactgtggtgggcagtgtgctgggccaccctgcgggtcctgccagagtgctgtggaattcaagtttgtcttctccagttttagtctctgcacgtgcgttggtctcctttctgcccctacagtgtggccaaggccattccagcctcaggagggcaagaggaggcctgttggatgcatcctgaaaacacaggccatcactgtgggtgagatctaccaggacagatgccattctgcaaagtgggtactttccatgagaatccatccatgtttttctcttattccttctcttggcagattttcactcttttcacaaccttgtttcatagacatcaaacaataacacagcacagaaggaaaacaagggtcttcttatacaaataccatgtatttaattctggcactcatgatttatttatatcagaaagtcatcttaaatttttaggagctcacaacattcaaaacctcacacaaatttctaaactagtagagatgtctctgcatctcccactactttcttctgcatgtcaagtttcactttaggttagaatagtcatatatacccgttgatgggtgcagcaaaccaccatggcacatgtatagctacgtaacaaacctgcacattccgcacatgtatcccagaacttaaagtaaaataaaaataaaaaaatcacaacattggaaagccaaaaaaaatagccatatataaactttttcatcttaaaatccattttactcctaactgtcaaggaaaaacagatggttctaaactcctccttctaggctcctagtggtaaagcaatttgcaggacaaccatggaagaaaggtgcccgccttctctaagctgacatggccccgctccctccctcagtctgtagcctcaggaggggactgctttgcctgtgagtgggagggagctaccgtgtgagtagttcccaacagaccatctgaagtcattttcccaggtggcaggagaaacacagagccagacgttacactgcttttcaaagaggtaagctctttttttttaactgctatttaaaactccaaacaaaaatgaagctgtggatgcatgcaagaatgaagcctaagcaaaaataactcttcaaaaaggaagcaggttttttggagagggtgtgtgtgtgagggcggggcgggggcgagtccttcaatgtggttttgaaattaaggtccatgttctgtgataataagctatgtatcaatgagaaaggctgagattatgacaagaggaaaaggagtaaaggatttggcggtttaatcacgtttctattcttttttatatctgcatcttctttgaatgcaagtatcaagttctgtttggcttttgtggaaagccatttccgaagacctgccttacttgactgtttctccctctctggctctcctgttaccaacgtcctagagttgcctctgctgccccagcgaggatggcgacacaaacagcggtggtgtcagcggacagcggtggtgtcagcggtgaccgaggcagggccgagactccagggcccttcgggttcaagctgtgccccctcgcgcagttcagcacctgccagcacttccaagtgtgtgattgtcacgcttgcctgattactccttcctttgggctcccatagcaatttgtacattactgtggaattgatcaaattgctttataactagctgtttatgtgtctttaatctgtgtcattttggatggcaggaaatgctctttcggtaatttttttgtccacactgactggaatactggttggcacatagtaggtattcaacagttttttatcgagggaatgaaagctctctaaaccacagcaatcatttgtagacaaagactcttagggtgtaatgtgatttaacatctgatttttggaaaatagttactgagatcattccgacaataatagagtgcaataccctaccttgaataaaggatattttactcctttagtgtgacatataggtgtttgttaagcccagagattaacttcctttacgacatggctgagctggcccagcggtccatgtcaggatgtggtgccctggtttactccaggttcatagcaaatcatttttcctctatgaaacctctttcagatgatctttggagcctgtatcatatgtgcagggtcaaaaaacgggctggatacagtgttccacttccagggagcatctctagtttgagcccagaccaccaacccccagcaaggccctaatccatacagttaaatccttggtagtgactttgtcagtttccacctctggatctttaaggaagcagcacttcctgaatgtggcattgctttgtggagacagtgactgagtaagttaggggtgatccttgctactgctggtgagccaggcacccagagagagtctaccacttgctgcgtgagcctggcctgtgctttgtccaccaagctggtctaagcggactcacagaaggcagaggtattgtggaagctctgatgactgccccatctctcctttaggacagaagcacttactccaccagcttcttggaatgttggcagctgaaggggtggcaagcctttgctgtagctacaccacaattcaactcctttgtctacccaatcccacttccttcagttctccatgggtattgatctggagagaaactctcaaactttcttcttgcaaatttaacctcagctccgtttcttggagaacctcacctaagacaggtggcaactctaaccctcctgcatacctaaacttactgatagatttagggaataagagagggagacagagaatgaagctgatatcatctagactcatgacaactagttctgcagactcatgttcatctggggcactgactctcccagttagcaggaggactctaacaccagcttttgcctaaaccctagcctcttataagctacaatcatttagtcacgaccatagggaacttcccggactgaggtctataaagcattcataaaaattcagatcttcaggaatcatagcaggatagtaaaaaggcaaaacttttacctttaaggaaactcagattcaaattcttgctcctgcaattatgagataataacaccaggttgcttatgttgtcatcccaatgttcagtgtcatctgtgaatgataacaaaagccacctcaaataactcttgtgaggtttaagagaaaattatgcgagacttaaaatacaatccgtgatatataagaacacactggattttttaaattgagagattctaaggtggggtgctgcggctcacgcctgtaattccagcactttgggaggccaaggcgggtggatcacctgaggtgaggagtttaagaccagcctggccaacatggagaaaccccatctctactaaaaacacacaaattagccaggcacagtggcgtgtgcctgtaatcccagctacacgggaggctgaggcaggagaatagcttgaatctgggagacagaggttgcagtgagctgagatcacaccactgcactccagcctgggtgacagagccagactctgtctcagaaaaaaaaaaaagagattcgaactcctggtttagtacttagcccttgtttaaagactgtgcaacaggcttaataacccccatttcaaattatttaattttcagaattttttatgatagaaaaccattctagcttaccaaacgtcttctgtaatagcttctgctcctttctgcttcatggctatccatgctttctatgatgttctactaactcactgaatatttttttaaatttagagttatgaagacttattccaatccttagtgaattaaccaaactctgaagagaatattttcatctctgttcagtgggttctgtctgatccaggaaaaaaaaaaaaaagttttctgatggaactcatcaagagcagcctttatccctgccttccctggctccgaatgttgtgttgcttttaaagcagtcaaacacatgaaaaccagacttttcttagagctctagaacttccttcgtggtactcaaggcttcctgggaattccttcgtcgttctcaaggctgtcctggagcttccttcatggtacccagggcttcctggagcttccttcgtggtacccagggccgtcccggggcttccttcatggttctcagggccgtcccggggcttccttcgtggggagcttccttcgtggtacccagggccgtcccggggcttccttcgtggttctcagggccgtcccggggcttccttcgtggttctcagggccgtactggggcttccttcatggggagcttccttcgtggtacccagggccgtcccgaggcttccttcgtggtacccagggccgtcccgggacttcttcgtggtactcaagactgtcctgggcacacggtttctgtgctcggacacccaatgcctgaactcagcatctgacacagttcctgggtttccaagtgagcaaacgctttctctttgctcttgggcatgaggtcacagccttctcctttcccgtcaggaccgcattcccaggttttctccatttctctttaaaggaaagtcgtccgcgttgcttcctgacctggagtgtttagccgcggaagacactggcctcctctggagtcgctgtgcagagctgcgtcttcttccccctgcacagcgacagcgcagacttgcttccccccattcccaacaggcaccttttctctttcaaaggtcccacatatacgacttacaaggcagtaaaagggtaatatgtgtgccagtacctttcaggtgaagtggcaaataggagggcgataagggttaaatacttacctgcggcggaacgctgcagtttttattcgtttacataaacgaatacaatgtatatattagctcctgcatacgcggggaaaagtgagggaagaggagcgggagaggtggcggctgtgggagcggagcgagcaggttcccgggaggctgcagcacagaggccccacgcaggcgggctccccgcgctcggctcccgcctcctcccggccgttctctgttcttgcacttggccgcgcacggacgcgcatctctcctcgctgccggtggccatgcagaaagctggcttagtctccatcctaggtccgcatctcagtttttttgtttgtttttgtcttttttttttttttgtcacaaaccgaagtggggaaaacatttgttggagttcgttttttttcacaaggtcagtgtgtgcccattacccactgggaggaggacaatttgagcacacgatcacattgaatgagaagacgaaagacgtggccgggcgcgatgggtcacgcctgtaatcccagcactatgggagtctgaggcaggaggatcacgaggtcaagagaaggagaccatcctggccaacatgatgaaaccctgtctctactaaaagcacaaaaattatctgggtatggtggtgcgagcctgtagtcccagctgcttgggaggctgaggtgggagaatcacttgaacctggagggcggaggttgcagtgagccgagatagctccactgcactccagcctgggctacagagccggactccatttctaaaaaaaaaaaaaaaaaaaaaaaaaaaacagaaaagaaaaagaaaacgaaaacgaaagacataatgtcgtaatgatgatggacaattccagtaattaaaattattttagaaaagcattgatttcttttaaattaaaatatgcccagaagcttatattttatatgtatattcaaataactttttggttattcagtcttctttgttttaaaacacttgtgagctgacttttctatttatacaggaggatgttctatatctcagaacaataattgcgaatgccatataaatactttaaatttacaagagtatctctcactagctaacctacaattcctttagtgcaatagctggggaaaagagtaggattctagggaaaacagttcttggttttaacttcattatgttctgcagctttattatcattgaaattctccaaattaaaatgcaaaagctcagcttcttggctgggctgcttacttaaccttaataaaatataagggtctgtttcattaatcagaaatgcaccagacacagtgcataaattttatcttccactttgtcctttgtatttcagaatgataataataataataaaatcttgggtttggcaggacaatcatgttctctttgtttctatcatgtttctatgtaaaatagatttctcagacagactaaatgccttaaggggtaaaaattcctatgatcctgttctctggaaatctttaaaaatagaataaactttcctttgtctgggtgtggtttaagcacaggccatgtttggcagaaggattgtttaactgacctgctgatgttgctttaagctgcatgatcacttggatgaattttcccttaatccttgccagatttaatttatcacaacaatacttgttttatagatgttgtaaaacaaaagtcgggtgcaatcttctttttcattgtaaagtaatacaacagtttatttctcaaattggagaaagtaaaattaaatcaggaacatgtatgatgtgttttccttcctcagatgtctcctgaaggaaagtgaaatgtgctaaatagcatgccatttaagacaatatcttttcagacaactggaccaaatcagcaaaacagaaccatgtgttccatcagggccgccttcacgttgtgccgtgcatctgaggctgggcatctggacggagggaggagactgaccacgcggaagtgtgctggtgggcgctggggggacagccagtgggacggggtggagaagtggtttcacaggtgtgcttaccccgtgtcagtacagcccccgttgtgcatgcgtcattctatcctcttcccagacgtgccgtccagtccccctgcctggagtgatgtgttatgaaagtcttcactttcctaagaagccccaaagaaaagcataaggttatcattcagcacatcaatcactagcacacacgcgcccatgcacacacagagagaaggcgtaacaatgggtcaggtttttaaaaccagatttcatgtatagttaaattcaaagtcatattttcaagcattgaccaattcttttttctcttaagagagactccaaagtttctttttaacagttaagctttattggggtattgttcatttacctgaaaatacactcgttataggcatctaaatcaatgctttttagtgactttatagaattatataaccatcactaccatcccattgtataatgtttccatcactccaggaagttccctgggcccatttgcggtcaatttcctctcctctcctcagttccaggcgagcactaactgctttctgctctatactttttctaaacattttacataaaaatcacaccatgcaatataaggtctttgcgaatacgttgtttccttactctatactttttctaaacattttacataaaaatcacaccatgcaatataaggtctttgcgaatacgttgtttccttactctatactttttctaaacattttacataaaaatcacaccatgcaatataaggtctttgcgaatacattgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatgcgttgtttccttactctatactttttctaaacattttacataaaaatcacaccatgcaatataaggtctttgcgaatacgttgtttccttgctctatactttttctaaacattttacataaaaatcacaccatgcaatataaggtctttgcgaatacgttgtttccttactctatactttttctaaacattttacataaaaatcacaccatgcaatataaggtctttgcgaatacgttgtttccttagcataatggtttgaggttcatctgtgttgaagcctgtgtctgtggttggtgcctttttattgcctagtagtgtttcaaaatatgagtatatactttttttcccaaaataattttctggttgatagacatttggcttgtttctacttttggctattatgtacatgctgtttgtgaatatacacatacaggtctttgagtaaacataggttctcatttcttttgggtaggcaggtactcaagaatggaattcctgtgtcatatgctaagtttgtgtgtaacttctttttaagaaacagatattgttttccaaaacaactgtatcacttgacatctcatcagcaacatatgagagtttcagtttctccacatccttgctaacacttgttattgtctgaaattttttttctttttttcttttttttttttgagacacagtttcactccattgcccaggccagagtgcagtggctcggtcttggctcactgcaacctctgcctcccgggttcaagcgattctactgcctcagcctcctgagtagctgggattacaggcacgtgccaccacacctggctaatttttgtatttttagtacagatggggtttcaccatgttggtcagactggtctcaaactcctgagctcaagtgatctgcccgcctcgggctctcaaagtgctgaggttacaggtgtgagccatggcgcctggcccattgtctgaatttttattatcatcatcctagagggaatgaagtggatgtaattggatttacaatcacgcaatgatttttcatgttgagcatcttttctttctttctttctttctttcttttttttttttgagatggagtctcgctctgtcactcaggctgaagtacagtggctggatcttggctcactgcgacctctgcctcctgggttgaagcaattctcctgcctcagtctcctaagtagctgggactacaggcatgcaccaccatgccaggctaatttttatgtttttagtagagatggggtttctccatgttggccaagatggtcttgaactcctgacctcaagtgatctacccatctcggcctcccaaagtactggggttacaggcatgagccacccgcctggacattgagcatcttttcatgtactaatagtgcatttgggtatcatctttggataaatgtctattcaaattatttgcctattttaatttttattcttttttattttaaaattgatacataatagatgtacatattttgggggatacatataatattttggtacatctaaataaaccatagaaagatcaagccatataatatataaagatcaagtcagggttctttacctatttttaattttttaaaacattattgagttgtagaagttcttaatatatcctggatacaaattttttatgagatacatattttaaaatattttccattagtccgtggcttgtcttttaattttaatgatgtctcttgaaaagcaaaagttttaacattttcatgaagcccaatttatcaatttatcagtttttcctttatagattatgattttagggccacatctaagaaatctttcctgacccaatgtcacagatattttctcttatcttgccacaagaatttgtatagtttcagctctcatatttaggacaaggatccattttgagttgatttctagtgtgagatggtataagataaggatgtaaaattgttgctatttttgcctatgaatatccaattgttctagaacaatgtattgaaaaaattatcatttgtccactgaattattttgtctctgtgtcaaaaatcaattgaacataactataagggtttgattctggactttctattcagctccactgatctatgtgtctatctttgggtcagtcatttttgccttgattactgtagctttatagcaagttttgagactgagaagtgaaggttctcctactttgctgttcttttgtgagtgaagccaaatcattatattagtactactcctctcactataagcaatggtttaatttccacgcctgaaaaaaaaatgacgagaaaggggatcatctgcaaaagtgtttgggtctttttattgctgcctgtataagttagctgttgctatgtaaaaaaccacctcaaaactagtggcttaaaagaacaaccattgatttagatcccaactccccgggtcagcaatttgggatgtgcttagccaagcaattctccccgcctcagtcacgtggctgaggtccgtgcccagtcaccctggcagccctgctcctggggttgactggatgtcagccgggccatggggtcgctgggccatgtgtttcacattgccgtcagacgagcctgagcttgtttccgtggcagcagggtgccaagaacagcaagagggaagactttcccgtctctgtgtctcttctgctaaggtccttttggtgaaagcaagtgatgaggccaagaccagggtcaacttgggagggccttccaaaggcgaatacagggacacatgaactcactgaaggcattgctgggatccatggaccactgcttttaccaacttgcaggagctgctttgagagaaccaggtttctgggcatgagccaaatcaaagtttaaaccaaagtttaacaaacccactacttcaaagtggtactcagttttggtggttggtacttagtttggcgcagattgcccatagacagatccctgcatctctactgatggctagccctagtcatcaaggacatgggaaaataaaatggtttcttaccattttcctgaggatcacaaaactttgaggaaaccagaagacccaaaagtatatcctcaataaaaccaatctgggacccccaactccattctatcctcaataaaaccaatctgggacccccaactccatcccttcctaactaacatgattcacctttagaatgagacgatcttagggattttaggagttcatggaggctcaatatggctgctgtaccttagagctacatggaaggggtggtgccctcaccacgactatgactaggcagcagggcattcctggcattaagaagtactgctcatctgtaaataactcaaccacacaaacttgttttttcctggaaaaaaaaaatacaagcaggtgctaggtttttaatgagagacaaagctttatttccaaattcacagtcttcatacttcattattgccttttcgccatgtgatgtgggtcacacacaatgaacaactggcaattgttcacacttttttatattctggcaatgagtgccaaaaatattcctttctcttagtagatctttttaatcaaaaatctatagtaagtaatgctttattttgaactaaatcatttcaataggcaaggtgacagaactgtggctgaaatctgcaccatcaaattgacaatcaaatgtctatttttttgtggtgagctttgtctcacatcattgtatgatgtgctgccactgctgtaatgaaaatacctggactatttaagcagatgagtgggtgtggaagtagaagagaggaaggaagcagagttgtctgggcactgccctgtaagtacagttgacctggtctggagggcagcgctttggtgagcagtcctagttccttagcccagaacttaggggttaaaaagactctgggccagccaggaacaccaacctccatttacatataaattgggaaaaatcactgagcaaatagttttacaaatacaattcatttgtaaattggggttaatctgacatgtttatttcaggatatatagataagagctggatttatatgaaaactgacagactttttagctaaactaagcaattaattcaattccatgcagagagtacaataggcttcttgtttttctctttgatctgacaagtgtgttagttgagatgattattttgcagcattatgttgggatcatggataaggaattggaccagaagaattgaagttattgcaagtccaaattacttcaggcatcaagcgagagactagtttctcttcctttctttctttccttctttctttctttctttctcccttccttccttccctccctccctcccttcctccttccttccttcctctcctctcctcctctctttttcttttctttctttctttcttctctttctctttcttcctttctttcttcctcccttccttccttccttcctctcctcctctctttctttccttcctttcttccttccttccttccttccttcctcttatataaatttaaggtatacaagtgcaattttgttccatggatatattacacagtggtaaagtcttggcttttaatgtaaccaccacctgaatagtagacattgtacccattaagtgatttctcatctttttgggggcgggggacaaggtctccctctgtctcccaggctggagtacagtggtattatcgtagctcactgcagccttgaactcctgagctcaagcgacactcccacctcaggctcccgaatagctaggactataggtgtgtgccactgcacccggctaatttttattttttatttattttttttgatagaggctgggtctctctatattgccccaggctgatcttgaactcctgggatctggtgatcctcccacatcagccttccaaagtgttgagattacaggcgtgagccactgcgcctggtccttgcagctgccagtatataaaggagcttctgagaaatgtccttggtcagagacaggcgcagcagctgccttctggaatggtgttttaagtgaggcacatgcaggcttcgggttctgtttcatttgtggatgaagcaagaaagctgctgcctgacaaggatgagtggcttcgttaattaaattagcagtggaaattttactggctttaattagtgtaaaataagccacagaaataaagatagtgattaaagcatgctaatctgattagaatcacagtgtgcgtggttataggcaacttgatattagagaatcacagactaaggccaggaagaggcagagtcctgttttaaagaagaggatggttgcagatggcacaaaaacttggagctgctgcgggattgccaaattgcttggggaggattatgtgtgataaacgccatgaaaatcacggggcatcgttgaaagagccatgttcctaggaggaagggctttccgaccattcacagtgaaaggagctgaatccaacttcattgctttcctcagcagaggaagactttaccagctgagtttcagcctctcaaaatttcaaacatatggaaaatcgacagattagaaagattctaagatgtttgtactttctctttcctgacccatacaatgaaagcagtgttcatttaagacagtgagacacaggatattcaagtgtctgctgtatgagagaaatgctgtcttattaaattcaatgcaatacaaatcacatctttaaattattgcataaatcctttccaatgctcagttccttggtctaagttatcatagaactgattttagcttgagtgtggttacgtggaaactgtctattttactcccaccagttcccagccttctctcatttcccggtttgtaaaatttccatttgccccaaagtctgaatgttaaaacaggtagtctgtctttgtcattttctgtgtgtatatacagtgcattgtttataagactgttataatacttagatattcataaaccaatagaaacataacaaaatttgctattaaaacagaaaccaaagttttcggaagacacaaattctgaattaaataaaaacagtagcttatattgacttaggtttctagcatttggcattgactattttacatttttatttcttcagtatgggtttattgtaagaatagattttccttcagttttgcaaatgatgagatgtaatgagacattcactttggggccagtattatgacagaaggttatggctgtttcaaatcaaattagtcagaaaatagacattttattgtcaatttgatggtatagatttcagccacaattctgtcaccttgcctattgaaatgatttagttcaaaataaggcattactatagattttttattataaagatctactaagagaaaagaactttttggcactcattgctagaatataaaaaagtgtgaacgattgccaaaatacagctggatagaatttattcattcagttgtttatatggatctaatacattaattataaatcacaatacagtttatgcccctcacaaaatactatgtgaagttcaatttcagtggaagtgccacgtaagtggcaacagaaatagacttttttcagccaacgagtagttgttgagtagcccagaagatgcattatttgttctgtgtattagttttttataggaatatatatgatcctgtaaatagatagactatttgtctgtcttagatttttaagagacatattaataatgctacttgaagatttagacactaactaggtagaacatgaagtctctctgtaagttcagactctttctcttcctccctcgtcctcaacctgaaaaccactgaaagccactaggtgggctgagccaggcatctgcgaggtgggaccagtggcacagtgcaggtgcagctgcctgaacagacccagatggcctctgtgcaggctgcggggctgttgaagccctgggggcaagcagggtttttgcacagagagaggctggcgggatgcctatggatgttccatggatgggtgttgagtcggagcaggtgaagggccctccttgcaggaggcaggggtcggggtacagtgatgggcgtggaaggctgactggaagaggggaagtccataggttggggagggatgactgtgacctggcctggaaaggggtactggaacctaagagagagaacaaggttgtttgagtaagggtgttggtggagtgaccctccacggggtatgaacctgagaatggggtgaggagggcatcttgggtggaacaaagatgatggcatggcagccctgcatggacattggagtgcaagcaatgggaggaggcactggccctgggagcacagtggagaggccagaaagggtgaagagagcatcccagtgaagactgggggtggggacgcattacgcactggggcagtgaagataaagagagccgggtttctcactgttggaaataggaaaagggaaaaaactggagtgagccctgtggtattagatgggaattgcaggtgttggtttaaactcatggttttcagtgtagaactatagacaggtacctatggaaataactattgctgaagatgcatgtgtgggtacatatatatgtggagtgtgtgcatgcatttacatgcagagattcaccagctctgtccgatgagagggtctgagagcggtgacacaggcactcacacttagtctatttagcatccacatattggtatccaaaatccaggcatcagtctaagaaccaagacccctaggagaaatcgttattctagggatggatcagggaccttacaaaagaaacacgaggtatcttattgtgctaaaaataaggaggtactcaaagaatgatgaggacatttcaaaaggatatggaaaccaggtagccaaactggggacaattttagcatcaatacaaatgagaagaaaccttttccttactgtagaagactagctgactaatgtataaggaaggagaaaatcatttgtcagccatcacaataataatcaggcaagaaacatcaatgaatgctaaaactagtggcaggaagtttggtgaggaatgggatactgtctgaaagtatctctacaaagggataaagagtaactttacatctaagaaaccgacagacattaacttaatcaaatgatcaaggtgaaaattaccaaataggacaaatcaaaactatctaacacctgtttgggtaccatgaaaacacaacatcatatttgtaatatttctgccccaaatgcataacctgaatgcaatcatgagaaaacatcagacaagccagagtgaaggaaattctttaaagtaactggcctgtaattctccaaagtgtcaatgtcatggaagccaaggaaaccagcaatgccaaggaaaccagcaatcaaggagtcattgctggaaatggaagattaaagagacagagtcacctagtagagtcctggattacaccctttgctgaaatgcataatcttgacccattggtgaaacgcgagtggtgtaagtgaatcagagggtagtaatacattaatactaagttgtctagtttgattattgtactggggctttagaggaattttttttgtaggagatgcattctaaaatatttatgggtaatgatgcaatggaacagcaaaactgttagtgaaagtttgaaaccatttcaagagagaaaagaaaaaacatcaggaatccaaaacatctgttttctagagctggctctgctgtgagctggttatttgaaggacgacaaatcactccatctctttatgtctccatttcttcatctcttaatgttccatggaggttagttaattaattaatactgcatgtgtcatcgggcatttataatctagcctaatcctgggagactaagataaaataccaaagcaaggttaacataagtgccataatacaactcaatgtaatgcaagatcctagatttgatgatgaatcagagaaaattttgctataaagaacatgattggggctgggcacggtggctcatgcctgtaatccagcactttgggaggctgaggcaggtggatcacctgaggccaaaagttcaagacctacctgaacaacatggcgaaaccccgtctctactaaaaacacaaaattggccgggcttggtggcgcatgcctgtaatcccagctactcgggaggctgaggaaggagaatcccttgaacctgagaggtggagtttgcagtgagccgagatctcactattgcattccagcctgggcaacaagagcaaaacaccgtctcagaaattaaaaaaaaaaaaaaaaaaaaaaaaaaaaaaaaaaaaaaaaaagaacatggttggaaaaactgtactgtcttcatgccaaatttaccaaatatgatcattgtattgtgcttatttagggcaatattcttctcttagaaaaatatgctaaaatatttggggtcattactctcaaatgactcagcctatacatacatacatatatatatatatatatatatatatatatatatatatagcaaatgtaaaaaaagttaacaattaatggaagtagaatatgggtattcttttatgatttttacagtttttctgaaggtttgaaacttttcaaattaaaatagttagaaaacatagtaagtgggatagtagtgtatatacagtgctacaagaatgcaaggtaattatattcaagataatgtatctaattttatatgtctgaggccccacatataagctgtattggtgccaagcgcccacagattctgaagaacggcactggccacacacctccacaggagacataagaggtggcccagaccagattcagttcattagccccttgcaacccacgggagaaagagggaagattattctgaggcacagagtggttaggtaacttgtccagagtcacacagcgagtagcagagccaaggagtggaaaatcacacttttcccagtgcactttctctgtttaactgctcctctacgcgtcctgaataatgatgtgttgaactcagtttgaatgtttcatgttagattgttttgatttttttctatttttaaagtttcatttggaataaaaatgtccaaagaaacccaaatatatttggataattagtagtgaaatagccaaattgaaactttgctgatctgattacttctgctgccataattattgtgatttgtactccgtaatgattataaacgctttgtctggtcaatgattttgaagactctcagagcaatcagatctattatgctgcaacttggatggttaaacaaattttaagttttagaacacataaaacatacatcttaaaagaaacaaaacccattcatgcataattagtaggtctgagattaaaaaatgaaaaaaatggtgttgagcacactttctccaagtcctcctccaagtggcttttctcacgggaacaacatcacaagaaagacagcagatccacctgaggcatgacgagacagttccttttgagattagggcaatatatgtgttttagaagatattcaaaaataaaatcataaatattatctttctaagaaagataagggacagtcactgagttagacaaaaatattttgggaagaaaatggtgaaaactgaagtacctttataaaaatactgtaaaatgtgagtgttttgttattagaagaaagaggaaactgcataggtggagagaagctgggctctccacgtgaagtaatggtgctcttctggattctgccatttcgggtaaaccagtcttgcgtttttcctctgatatttacctcttctcactgtgaagattcagccttcaaagcagaacctgacaggttgtgctctgttaatccggccttctggggggctgtcaatagcagttgaataatagcaacgactctgtgagctcaggctgccctctgctctcattcgtctcaggcaagtggcagcagagaatgcgcatgagccattcagaacatttcacaaataacttacactcggagtcttgaataatgctactttttttttaagttttattatgttcatcatgaagctttaaaaagtcttttgcatttgagaggaaaaattatcatgtgaaaaatgtccagttctgcatctcgattatttaaatggtaatccaaagaagctccttctcagaagcaatattattttacacgtgccctgccagaggccactgtgcattgtcccaatcaaaaatcttgaagggattagtgtagcgaagagtgtgcaattaactatttctatttgatatgttcattttgatatttataatgtttgcttcactttctaattgtgtgtgtgtgtgtgtgtgtgttttgagacggagtttttgttcttgttgcccaggctggagtgcagtggcgcggtctcagctcactgcagcctctgtctcccgggttcaagtgattttcctgcctcagcctcccaagtagctgggattacaggtacctgccaccatgcctggctaatttttttgtatttttagtacagacggggtttcaccatgttgcccaggctggtcttgaactcctgacctcaggtgtctacatgcctcggcctcccaaagtgctggaattacaggcatgagctactgcgcccggcctcactttctaatcgttacttctcagttgtgaggcgtgttagggcctccacagacaggtaaaggaaaaacgggtacagatggaatcggggctaatgggattctccttgaggagtgccgtctgtacctgggaaaggctgatgttttgtacaacagtgtccgggagcagtggaaaccctggatacaaccgtggtagtgttgctgtcccagaggttaacctgttgagtaggacacggaagcagaaagtcactagacaggcgtaaagatgtggttagagaatgttatcttcttaattgcggggagatctgccatgaagtgaggccccagctggccgcgggagggtggagggaatatttccagcccttgaggctggaggtttgtaaatgcttactggatttggggtcaagataaacaggctacatttcagggtaaaatcccagtcccagtggcagaaataggttctcttgggaatacaaggaaaaggccagtcctcaggacaaaaagggtatgaccgggctttgctttacgcataagcggacactggattgtagatactgggttcaggacaggaaataaatccccttgtcctccgcggtagtcctgggatgcactgtcagctgggactggatcagggctttggttagactagattttcaggttgaggacgctgggtaccaggcacagcagcagcaggcaggagctgatacacggtaagatttcaagggtcagtgaattacctatttctgtctcagcccccagagcctcacacagcattagcacaaagtggatgctccaaatgggtactgagttgacatcagtgcatcggacagcacgtttccctaagtatacctaagtaaatagtgcaaatccatgtctagaatgcccatattgcctgtttaggatggttataggatctactcaaactcaataccttatttcttctcctagttttgagaatggtctttgaaaatattttcttttagtgttccactgaatgcactcaaataataacattaatttactttaaaattgaattaaaccccatacacatttctctacacctgtagattggttatcaagaataaaattgtggtgaagtttgccacactgaaatattagcattatggaaacaatatccaacacattcagagttagaccctgctcttattattgaaatgagatatttttgatgtatacaaatgatgctactgaaaacgattggaagacatgctccttgaacattaataggaagatttgtcccacgtaactcatgttccctcaactcctctgccttgtgaatgctgcctgtgcttacagatagtgatgaattgtgtcattaagggatactatgtttctttccacttgcccacatacaacaattcacaattcattataaccaagaatatgtatcttccatggcattccatgtttcttcttgcataagggttctgttaactaggatttcatttgcaaaatttgcactttctaaaaatttcttagtaattgtgaagtttaacccactcttatcgcatatttgaaaaccaaaattcagagaactggagtaactttgcctgaggtcaaacagttgctattgtgtgggtcttgagattctatttttcagactagcttttttcaccttttgtatcatctacctcggatttgcaaaccatggataaaatattttttgacaacatataacttactctttataagtataatttaagataaatataataacttaataagtataatataatttatattatattgtaaatattagaaatatattataaatatataaaataaatattactctacaggtgtagaataatttataaaccctaaggcaatataatttatgaaaccttaaggcaatataattccttgaggcattattaatgatataaacttgaattcaattcacatgacaatgatgaccattttaaaatacctttcgaagagatgcctgaacagggccaattgccggctgtgttgtcacacaaaatatggcttaaataaagctaacctgagttttcagaatatttgagtatgctaacataatgtctccaaaggaaaactatatatatttgacaaaatacatatatttttcctataaaatgtattatagataatatgtatatctgaaacaaatagatttgcatgatccctactgtgtacttttccccctttttgaccgtttagttatctaagtccactgtcaatttatataacagcaacctaactatctgaaatactctgcaacaagataagtcccaatgaaattaaatactgaaaggaaatattttttaaaagtagccaaatagcagatgtcttcttaatttccacatttgtggcattctgtggagaaattctccagataaatgtttacaatgtttaatcctcacatgaaggtaactttgacgtagacacttcccatattcgtccatataagaaactgaaagattaatgccaccactccagaaatactgatttaatcaacatttttattaaataaaattgattaaaactggtcttctttctcatgacctcatctcttacaatgtaactacattaacatgtataggggcatagtgttctcaatgctatcttcagatctatatcgtcaattacttactgaccattaagctcactattaatttaataccaacaaatagaagagatataattatcaagcattatcaattaatatgtacctagggccacagaatcatcaatttatagatctctgtttatctgtcattttcctttggagacattatattaacatactcaaatattctgaaaactcaggttagctttatttaaaaccatattttgtgtgacaacacagccggcaattggccctgttcaggcatctctttgaaagtatgttaaaatggtcataattgtcatgtgaattgaattcaagtttatgtccttaataatgcctcaaggaattatattgccttagggttttataaattactcttataaagataagaagaaattagctgaaaataactgagcctatactatggcatactaaacaatatctagcttatcagatagttaatttgtgcatataaaatgaatgtagaattatgtatgaggttaattcaactatctgtgtctgtagccattcatctacatattctagctcttgttcacatatccaatacatatttattgagcacctacttgactccaggcacattgctgggacagggaatatgacatgaatgaaacagacaaggcgtctgccctcaaaggtcctgttcagtgagaggggtgttgctgactccagttcctgctcccttgggaggcatcattcatcagtggagatatccttgccccagagcttgggtctcctcaaatgttgtgctctttgacaggtccaagaatgaacaaaactggcctgggaattaaaataatttgccttccctgggtgtatatttacatgtatacgtagtggctaataaattaggtgtttcaacctagacacccaggcacaattgataacaataatcaaagtaaagtttgacacagaccacaaaaagaagattattacaaatctgaacttttaacttcaaaactggttgcatgacttttgggtctctttgcaggattccttcaccaaagatcaaaatgcaaaaggtggaggaagactggaaaggaagttgtgaggaatgcagagaggatgtggagaggaatgaagggtgatgttccgcttagggagtcatagcacctccacccgaggccactgaggggggctttcaaggatgccttggcaaatttgcaggtaaagggccacagggcactgatgccacaatcatgcctgagaaagccgcaggggcttatgcggaagagagctctgtacccatgcaagttaataggagtgtgactactcagctcagagataatcatactggttccacttaaaaatgaattgtggccaggtgcagtggcccatgcctctaatcccaacactttgggaggcacaagtgggatgagtgcttgaggccaggagtttaagaccagcctgggcaacatagcaagactccatttcttgaaaaaatataaaaacaagcccaggatggtggcgtgcacctgtagtctcagctacttgggaggctgaggcaggaggatcactggagcccaggagagcaaggctacggagagccaggatcatgcctctgaactccaacctgaatgacagagtgagagtgtatctctaaaaactaactaaatcaaactagtaaaaatgaatcttgcctaaggggttttgcttccagggtaagggaacccctgtgatcacaggctggcaggatcatcatgaacagaagctggaataggattggaagcttcaggctcaaggaaaggcactgcccgtggcacaggagttgcaattgtgaggcttagtagaggcgcctttaaataactcacaaagcgtctgtgcaagaaagtcagctcgcaaacctctgccaggtctggaaagcagggcatctacttgtgaccgtcacgatcatgtaagaagcacaaacagtcatctggccactttgatatccaaccttccccaacctcagctgatggaagcaggaaggacacttccccctagccctcctaagtataggctgagggcagggactaagatttaacttcaaatcaagttagcgctttctaacatcatctggaaaaggaaattttacattactggagatcgtatttgctacttgaaggtttcatgggcctttctattatctaagagtgatccaaaaagtagtggcaattgtctgcattggcacttaagggcagggactggaccgcaagtattgaatgggtttcatgggacagtgggaagcaaaaatagaagtgcttatatcattcattcattcatattagcgtgcacttattgaagactcactgtgtgccaggcactgttctaggtactggatgtttgcctatgggaaaaaatatgtagaaacatccccagattcacagcatgttatagcagggagtgtgtgttcaacgtcctgaagatcatgttcacacacagatggatagacggtagacgacggagtgagtaactcacacaatctattcatttctctatcacctctctcaagttttcatggaagctaggctggtggaactacaggaaatgtgattctggttctctctgtagattatagtgaggttgtctatgtcctatgctggtcttcacttaaatcgtcagattcttgtatcatgatttctaagtaaattgcagaacttttacaaagttccactttaaaaatactgctcttccagcacaatttgccattgcaaaaatatggaaccaacctaaatgtccaccaaccaacaagtggataaagaaaatgtggcatttatacatcacggaatactactcagccataaaaagaaatgaaataatggcattcgcagtaacttggatggagctggaggccattattctaagtgaagtaactcaggaatagaaaaccaaatatagtgtgttctcacttataagtgggagctaagctatgaggatgcaaaggcataagaatgatgtaatgggcttcagggacttggagggaagggtgggagtgggctagaaataagagactaaacattgtgcaaggtgtacactgcttgggtgatgggtacaccaaaatctcagaaatcaccactaaagaacttttccatgtaaccaacaccacctctcctccaaatgctattgaaataaaaattctaaaagcaggaaaacatcctaaaaatgtttcaaaatcctttctctttactatgcactaattggcatagtaattggcactccctatccaaacactaggtcaaactctgaaagttattttgtcaattttctatatatacatacttcttaaataaaaatgtaatttacaaaataaaataaaatactgcttttcttcaattatgtgtataaccaaactgtagttttcctaatttacttttgaatatgttttgctacaagtttctgcttaaaattgtttctgcagggtttattacataaacatgtgccattttcttgctctttcataggcaagaccattgagaagatatttggaccctggtggcagttttttatgggttcctcagcagggatgaattagcgcaatttgtgttacatgcaatacaagcaggttctgggtgggtgatttcctttgatcactttccttcccccacctctcctgctccccgcaaatactcatacacagcctgccttgcaggtcctattagcacagaaatggaaggaagagctctgacttgtgggaaaatgttcatgtggaatgctctacgaccacatgaaagctctgaactctagtgtatagccgtctgtctgaaaaatttgccagaaaattactttatcttcatttatgtgtggcagaacaaatgtaaaactaatggaatccaaattttaaagtaggaaaatgtgatcatttagtagaaggaaagtgaaagcattttttatttaaacattaaaatatgattgattgacagttaaaatgatacatttataaaatatagaaaacttacaattctgctgctacgtatttgcttattaaaaacttgaaaaggatcatgtctgttttgtactcataacattgttgctgtcactcagtttcaattccagaagcttcattctattgatgttctttacactgatatttgaaatgcgtgttttagttcttacgtgtaagataaatgttttagtttatgcaatttcaatgttttagtttatgcaatttagccattattaaaaaacaatttggttgaacagtgtttattacatattcaaccacttttacttcagaatattgatagctaacctctatcaatttaagccagttcagcaaaaatactattgctttcttacgacagaccagatacagtactagtttttgtgttagctaaaaaatagtactgcctctgaggagcttgtcatccaacatgttgtaaggaaagagagatgtaaatttttaatttacacttttataatgcatagtgtatacatttataacttcagtaaaatgtgtaaggtctgtggcaaacatggacagattgttacttatctcttcctagtttctaatctatatccaatttctattaataacagagagagcacttggacatgagacaagaggctatgataagaggtatgcataaaaatgatggtggggtgttagaaggattgtaaatgctgatggtacacatgtggactgtgaagtgaagatgtgaagcttcaggaaagatgcgttaataaacaacatgtattaaaatactgattaaaatcatctgattaatccaacagtaaatgctctagaggcattaagttgaaactctcagaattattatctacttgaatcttgttaatttctcaaatacttctaatatattatttactacttgttagtttttaaaatcacaagagtaatgttatttgcacatttatatatatatacagctaaagccaaactaacgaaataataaatcttttcttcttccaacaatctgtcctctcttcctgaccttacttgattgttaatgatgatgcagaagtaattctcaggagagactgcaatagtacagtgcctggttttgaagtgcatattcagacaaaattccctttgctcaccactcggagctaggattctgagaatcacacacatcaaacacatatttcaggaaaagagactatgtcagccagccacgatagaagacacgtatgtagtgaagggagtccacactctcaaagccgaagcactcaggaaaatagaaacttatctgttatggggccaggaaatttaagaacataaaatatccacagaacttggcttcatgtaagcatcaacattatataaaagacaataatacatgtcatcagtttcaggagtaaaattaagagagttttgattggatgagcccacagcgattgaaatcaaccgacccataggcttttgaaggccagaatgatttcctatccagagagcataagtaaatcagaaatttgcagttgtgtgtgtgagccagcatttcaatataaataacattaaattaggcatggctactctactacatattgccatatcttcgtctcaccttccgttttctatttctttcttccctccaggtaaacaagatagaatcagggaatcttaagacacgtgtgtgtctgcgtggaggtgaggtcacaggcagagaaggcagtggagtgtccgactgggtgtaagagtcccggtgagagtccgaggaacccatagagacgatgggaaggtggaattacactccttttacacatcacatttcacactcgttttcgagttctaatttttaggagctccatggcattttttgaatatgactataatttgcttctcagaagcattaaggcaaatattttgagggatgttctatgtgtagctttttttgtgacttttcattcttgggcagaggtttctacaatcgccagctggttggctatctatgcatctctcagtcattgttgtcactttcccaatgacaggaaagtatgatgctatgtgacagcccattgttctgatcttccttcaacctttctttacaagatatttcctcatataatttattaatctaaagttgaatacactctatggaacagttcctaatacttttagacaaagtgtatcatatcaatttcatacctctacttatctgaacctaaaatattttctttaagcctcttgtcagcagttccttattctaggtaatatttgggtaaaaagctataagaatgaaatgtggaaatcattgtagaggtaaaggcttttactgtaggtcatagtgggttgggagtttgggtattccaggataattctacaggtagaattctgttagatggcatcaaatatgttgcaaatagaacactacccttagagatatgccagctttatatagaaaagtggctaatttatgtagagatccagttctgtctctaatttcagtaaatttagacagagaatctgtagcgtatatacacaaataagcttgctattggaacactgttctaatagtgagaccatctggaaatatctttggaacgtataaacattaattccttctagagaaaaatgttcattttccatgtctatttaattcctttttttaaaaaaaaaattttaggccttctgaatatgtgagatgttagctaaaaatgtaaattatgttctaggatatttggaatttacttgcctttaaaacaccataaccacttcaaaagaggtacttcttgtctcgtttgtaattctgtgatgtaaattctgaagtttcacacattgacaatgatggttattacagtattaacatcgccatacatctctttggttagtttaccagctcaattaatcatgcttcattttcttttgggctctcatatcagcttctcttatttttgaatgaaatgacttctgaaagagaacatcctctgaggacacactaattctcccacctttacggaaattccttctcagaaggggcagatttgctcagcactgaagccacgtcccagaagcctggggctccgtgtggagggtgaatgctgatgggagcctggggacctcagcttctaaagcctgtttctgccgctcaccgcggggcctgcagggctgagcttcatctttctgtgcttcatttcactgtcagtggaaagagcataatatttttatccccagtttcttgtaagtcgtttatttttcaatttctataacgaactctttgttcatattgaagcaaacctgtattattaataaatgatcccgtcacaatgaaacattcccctggctctgcagagagccgagggacagttctgtccccggtcaccagcgctcccctttcttaactggatgagccttacttacactgtcccctaaaagtcagtacgcagaggatttgctgactcagtctgaaaggacaaagtcccagagtttcaatctacccatttgaaacagtcattctctagtccttagtagaaataacacctgggagcctttagggaagaataaaatcttaattttgctgagagccagaagttttatccataatacctgtcttattattcaataagccatccagagccacaggagattggaagtaagtcactggctcccagatgttctcacagccatagtcttcactgcctgcgaacaactcaagaaatgagtctttcttctgttgctgtttgttcatacagaacaagatgagacgcaagcctcctgcttaattggagtattgaatttttgaaaatgtctggtcattttgttctttctcttgtttccatctagtgttgccactctaattagggaatggcagtgctaaaaatacagatgttaacaccaaatcagtccatcctaattatcactcaaaaatcaaacattttttagggaggcaaaaactgtcatgagaactacaatttgatttggagactatttcacttatacagtttcttcacatgatgaccagccttctttctttagtaatggttattactatggccattgctgttaattctgtgacttatcacttcccatatagacccaagcactgagctaagtgtttcacaggcattatcgcatggagggcactcaacaacgctatcagctggccattgttatcatcctcattttataggtgaggggttaaagaacacttccaagatctcatcgctggtcattggtagcaacagggtttaaaaccagatttgtccaacttcagaactgtgatctctctcatttgcaaccctgtctgctaagtaacatgatacagaattggttaaatactttccatatgaatgtctgcaggtttaggatttaaatcattctctaaaacggatttttgatataataaaaatgaccaatgtattctgtaaattgtattgcctaagtgtgggaagaagggctggaagcaacgcagtcattgattctgtgggaaaggatggacgtgagagacgcagccggtcaatatagtctgttattaatttcgaatacccaaatattagtcagatattgtttgtgtttctcaaaagtgtcatctaatttttattatttttttaaataatttttttattttcacttaagtaatgcatacatatagtaaatacttcaacaataaaaaacaaaggacgtaaaatgggaaatgcctaccttccctgtgttctgcctccccctactctctggttttctgtccaaagtcaaacacattcaattcctttagctcattccactggtagtaagcctccatattgctaaataatatgctcattagtctattgtctgactttttaattgctgacattatttttatctttattttaaagtataatatgaatataattatctcacagttttgacaatgtcaacatagtacaatatagttcatagtattctagaaaggcacacactcttgtattttttaaatatgtaaatttcttccctcttctgtctctgcaaggcctatctctaatttctctagtggtggggtttgttctcactcagtgtggagatctgggtctcttttttttttttttttttgagatggagtctcactctgtcgcccaggctggagtgcaatggtgcgatctcggctcactacaacctccgctcgtgggttcaagtgattctcctgcctcagcctcccgagtagctgggattacaggtgcccaccacaacacccagctaatttttatatttttagtaggacggggtttcgccatgttggccaggctggtcttgaactcctgatctcaagtggtccgcccacctcagactccaaaagttctgggattacaggcgtgagccactgagcccaggcgagacctgtgtctcttattgtatgcttattgtgttctgtttcgcttttgcgtctctttctgcattccagattttctttcaatgattcactctttcactataaacttcctttcaagaacaaggcatgagataccgtggaggagctcgagttgttacgagcacccttgttatttggtggagttgcgacagcacagttgggtttaatttagcttttcccctgggcacctccaaatgtcagtgtctggaggtctcaacaagagaaagttgaggatctcacagttctgtttccgtatttcactgaatcccccattttctacctattgctcaccccagctctccactatgtactgtgtccccaagtctacagcatctgttcatccacaaaacagcttccagcatcctgaggtggtgaggggtgtggttgagaaggtcatcggttttgctggtgaggggcaggagttgaccactctaatcacaggcattcaagcgagtcctgtggataaagtccggcacctgaagcctgcctcctgccagacccagcacctccagctctggagcatcttggggttctaggggcacctccagctccggagcatcttggggttctaggggcacctccagctccggagcatcttggggttctaggggcacctccagctccggagcatcttggggttctaggggcacctccagctccggagcatcttggggttccagggacacctccagctccggagcatcttggggttctcggggcacccagctcctgcttcactggatttgccgactcaggtcatggggtgtaaatgaccctgctctgcttcagctgctctttgtcctccaaatatttgggttttctatctgcacttttctcttttctcgttgtctttgctctaggtgttaacaacttttacattttattattttcatttaaaaacatttgaagatagaagagatttgtgtgagagagtagagtttgttttttaacaagaagcaaatttatccattatttatttggttaggagactttaatacacattttaactcattacagatcatcacttaggatgtgaaaagttttgtgggacttatagggaatttttatgctcccttaacggaacaattcaaatacataacatcgagccctataaatcgcatggcttttcaagtaaccataagatatttatataatgtttccatactcaggaacacagacaaaacttcaatgttttctgaaacagaaatagcatacactactcctctaaacatgatgaaaacaatctataaccaaaagaaaaacattacctgaattcttattatttgtatgaatgacaatgaaaaaaatagtaagaaacatagagaaaataaaataattattggagtagctttgggtgaactaacgcaaacgtaaaagttgataaaatggatgattttcatgaaaaacatcaattagaataataaaataaatatattcaattttgaccaaattcaaacactacaaataaaagctcttttccactaaaatcaagtccagtttccctctttttaataataaaatattactaatttaatggtttcttcaatgatttatagactatatgtaacatttaattcctaatatttttataataaactgtggtccatgtttctttagtgggatggctgccggttgtagagccctggtgagcaggctcagcatcatatgggaagttgttagaaataaattcttgggctctacccatgacctactactgaatcagaaactctgggacagggggtcagaaatctgatgcacttttggccaggcatggtggatcacgcctgtaatcccagcacattggatgctgaggagggcgggtcacttgaggtcaggaattcgagaccagcctggtcagcatggtgaaaccccatctctactaaagaggcggggctatttcttaagctgtgtgccactgggaaaataactggtgctctctgctcctcaattttcttatcagtaaaacagggattagagtgtgtgatcagctggcctcctaggcttctgaacattagtgatgaaatgcagaaacaagcttaaagtacagtgatgcctccagaaattggttctaccaagtgttagaaatgccagagcctgcaacattctccctcctgtcttcctttggatgacctcaaggcaacaaagactggccctgtcttttcctccctgttctaccgtctctggtcagtcactgctcttgggctgcatttcatcagaccttgccaagaaaatggagaccagggaagccgtcctactgggtggagcttctcttttggaggagtgacccgatcctaggatggctgtgttgtggtgccctattaggaagaagggatgtgtctggaagcactagtccggacaaaacaatagtctctctcttccagccaattctcagcatcctctgcagggcaagcttgtcacccagctgtgtcatgatggctaaaagtatgggggggcagacaacacagcctcaagcacaaccacctggcactaatttgaaaaccccagggctgtctgggggaaatgctgtgatatttcccattaggcgaaaggcagcttaacattcataatttgattgagaaaaatggagctattttataggccagtaggctccaaattgttattctactcagatctttattgcttggcctttcttaatttaataagcaacctgtatctctcgtactgaagacaaatagattctataagtgaagatctaaaatctgaagtgttaataacagaactaaaaatatagttttgtttatttttctccatgtcagattctgttttctgtacaagcaaaccaatatgttcttgctctgagggacatacttgaaatgacagaatcatggggtctccattcatggcactgccatagtaacagattgggaccacgatgatttaacattaccaggagttactgttggaacaggtcaacacaacgtgaaacctctgctacacatcccacacacacttggccccaagacgttgcttctactttggaaaaatcacttttccaaaatgacatttaatttaaaaaatctgtcccagtaaacaactttacactgaacaatatctgcattaataagagttaaggccctgaagaacaactctttggcattcttttctttgacaaggtctctgggaaccatgccaggaaaatataataaaatttactagcccaaaagttgtgtcctttcttcccttctctgtgtatccattgtctatgcgatgcttctttttcgtctttactttcttactagaaatttgagagccttgctttagtttatttgaaaccagccttatatttgcagtgttctgcttctgtttcaatgataggagaccataatctctttgtacaagcatcatcttctctttcaagttgattccacacattttcattgatctggatttcccaggtactgatgcaaacccttcatcaatacacttcacagcgctcttgtccatactctggtttgcatggtctcttcctctccctgaatcataagttacgaggaggcagggccatttccaaaatcaattcctggcagaagagaaagtgcctccatgcatcaggaaaccatttcaaacgttaacagttgatccaagggcattaattaaacttctttcataaataaaggctcactgctgccaaacggtggagtgcatgaagagacaattccaaggctataacttccctcacaaaaaagaaatgaagctctttgcagacaaagcctattaagcatattcactttcagattgttagacagaacaaatgagagggagcggcagaggcagtggagaagcccttcattcaaggaacaaagaatgcctcctgtactctttgccattgtgatcttgtctcaggaaaattcaaagaggctgaagatggggataattaagcaaatgattgataccaaatcaaagatgacttttgaggttcatttgatatcagtttcctctagggagagtatctgtttattccttttagtgcggctccccacgtgaaagattaaaaatgacagaacctttgttaaacagtttaaaagaattagagagttttctttcctaggctttgactgaagagattctttgccaattaataaaagaggaaaagtggaaaaattatagaatgagctctcacagtcactttagttatggaattttcctatttgggttggctatcaggtcttaacaaaatattctcaagggaaagaaaaccaacagcctgacttttgttgtcacacgggtactaagccatattgagaggaagtgcaggctgtagaaaaccataagggaatgtcaggctaacagagacacagagccgtttacccacttccgagactgtggagtttcacatatttctaagatgttaagtgagaaccatgtcacagatgacgtagaatgtgcatgatgcagaaaaatacagaagcttaaaatatatttaatacaaatggaaaagatgtttcatttaagcaatatatatttttgtcttgaaattattcaatctaattttaggtgcagatctgagagctgttaaattttccaaaggataattgacagtcaggataaagtgcagtcaatccccaagcttcagactttccgtcttcatttggaactctttccaggcatccattttcaatgtctatccgttttccacattctccctggacctgtcttctccctctctcagtggctcataccccttgaagagacaactggtttggagagcaaaacagaagcagcaaacatgatggttagtttcaaggcggatggtgccagggccaccaggcctgaatgtgagccaagggaggacagggaaggcgctgaaccctggtcaggtcggtgatggcatctcacagaatttgggctcagaggcagagctaggggctgaggtgcagaggagtcaggaagagacaggacactgcatctgggactcagcaacttgcttttctttccaccctgagtatgttttctaattgagatgagattggtttaaagggtcagaactagggtggactgaacattttgctatgtttagtcacacaccatccaattcttctcctcagtacaagaggacattaggagtatatgtagggcatgacactacagtagtgggaagcagcggtttggagactaataagggaaatcaaaaatcagggagaaggtgaggctgcagggtgcacaggttgccagggttcccaagccagagagaggctggaactcaccaaacaaaaggaacatgttgtagatactcaggggtcagatgaggggtctgaggatccagcgctggaatccataaaaataaaagtctcagaaaacaaatgaatcctgacgattgtgatcaagagaagaaggaagacacgaatacataatattgtgaatgaaaaggggcccacactaaacacagaagtaaaaaagatgatgaaaactataccaagaactatgttattgaaataaacaaattgtagggaaaatattgcttgtagaaatgatttaaagagaaataaaaagctcaaattgttctataactattaaagaaattaaattagtgcttcaaatcttccttcaaataaaacagcagaaccagatggctatatagatgagttctctcaagtgttcaaaataaagagtactctttttttgctttttacaaactcttttaatggttagagcagagagagtgtctggcctgttctacaagagaagcagaaaccccaatataaaaatccaaagaagacacataaaagaaataaaaattgcaggtcaatttcactcatgcaaaaatcattgaagaaaatcaaatgcaatgtgtgttaaaataagagaatacaccaagacaaagttggatttatcttaggtatgcaaagatgatttgatattaaaaaataaatgtagttcatactaataaatatttagacagtgaataaaattcacattgaaaatagcatagtagaagctcagagaaaacttgcaatacaaaacctattgaaatctgctcatcttggatttttccaagacttacttgcatactgaactcattaaaacttatcctaagaataacttaaaaacatatttgctcttaagtatttgaaaggggcaacaaacaatgtatgagtctctcaagattgattctacatatttaatttctcttttagaatagtgtgctgcggtatactggaagtcaccctgagacagggtccatgagctacgatttgtagccttcatgctgccactaataagctaagtgacctttctacttatctgtattctagctttctaaaattcaaaatgaagaagtgtggtcatacaatctgtataattgcttttccctcctcagagttttgagtttttctaggttagagaaatataattttttatacttatatgcatggttttgtgtttttgtactataataaatctgccaaacgagagatcttctaccattttgataaatttgtgtggcatcagttgtctaacaaaatatagtttcaacacttttaagcctctaccagccatgatccggagtccaagaggacctggaaggcagtccattctgagcaggcaacactctggcaaggtcattctgctgtgtctaccttcacatgcaggttttgacactagggtcattaggacagtgctttttcaatgcagtacacattttgaaatgcacactaatttcgtgataaaacataacacaccatcagccctttcattcataagtatcaccgatttctgtatgtaacatacagcctccttcgaacctgcatcctgagctctaaactcttctgagccatgctctatcccctcaggatcaaaatgccttacagctagaaaagttcctaacaaatagtggacactgaataagtgattcttaaaggattgaggggatgatcgttagaattttacattctatactgacttcccacactcacttttgaggaaagaactctttttatgattttttcaactgtggtgcccctagggctcaaaacagatctacatccatagtgaatgaattaataaagtattaatgcagtcaataagtgaataacaaaggctgttcaatctaacacaaaggacatttaataaacacataccatgtgttaccatatgatgtgtatatgcattttagataaaatcatgaatatagggataatgcaaacgataaaaataattgaggacataggaaaataggaagtgtttataaggaaataaaacagacagcttctaaagtggcttcaatgatcttacctcttggtattcatgccattgtgaaatttcctccccttgtacgtaagctgaaccaatggactttcttctaaagaatagaataagtaaatcaataaatgggattcaccacataaacagaattaaaaacaaaagccatatgatcatctcaatagatgtagaaaaaagaatttgataaaatgcaacaccctttcatgataaaaagccttaaactaagcattaaagaaacataactcaaaataataaggaccatctatgacgaacccacagcgaacatcatactgaatggacaaaagctggaagcattcctctggagaaccagaacaagactaggatgcgccctctcaccactcctattcaacatggtactggaagagctggccagagcaatcaggcaggagaaagaaataaaaggcatccaaagaggtaaaaacaaagtcaaattgtctctttctgctgatgatatgattctatatttagaaaaccctaaagattatacccaaagacgccttgacctgataaatgacttcagtaaagtttcaggacacaaaatcaatgtacaaaaatagtagcatttctttttttatgtctttttttttgtcttcaacttttattttaagttccagggcacatatgcaggatgttcaggtttgttacatagctaaatgtgtgccacagtgttttgctagacagatcaatccatcatctaggtattaagccaagtatccattagctgttcttcctgatgctctcccttctcacatgcaccaacaggccccagaatgtggacacgtgttccccccatatgtccatgagttctcattgttcagctcccacttgtaagagagaacatgtggcatttgtttttctgttcccgcaatagtttactgaggataatggctcctatctccatccatgtctctgtaaaggacatgatctcattcctttttatgactgcatagtattccatggtgtatatgtaccacattttctttatgtagtatatcattgaagggcatctgggttgattccatgtctttgctgttgtgaatagtgctgcaatgaacatgcatgtgcatgtatctttataatagaatgatttatattcctttgggtatatatatataaattggataaataaatgcagtacatatacaccatggaatactacagagcaataaagaagaacaaaattgtggcttttgcaacaatatggatgcaactggaggccttatcctgtgttaattaatgcagaaacagaaaacccaataccacatgttctcttttctaagtgggagctaaatgaacacttggtacacacggacacaagacgagaacgataaatactgggggttccacgaagcggcagagagacagaggggcaaggctggaaaaactaccccttgggtcctgtgttcactgtttgggcgacagcctcagctgaagcccgaacctcagtatcaagcactatatgcacatgaaaaaccgacacatgtaccccctgaatccgaataaaaggaagactcctttttagcgatgggatgggatgttggaatgtcacgctgagatcaggctgcacaaaggcagggatttgcacccagcccactctgcagtgcttttcacttgcctgttcggtctgccatgttgagagctgccccagggaaaggcccattaggcaaggacctgagggagacccttgtccaaaaatcagaaactcgagatcccagcctaatagcttgagaaacactgaatcctgccaatgaccccatgaatgagcttggaaatgaatcctccctttgtcaaggcttcagttgagaacacggacctgaccgaaatttgactgtgatcttgtgacataccttgggcagaggccccgggctaagctgcccccacagaaactgtgagataataaatggtggttactttgaagccctcatgttttgagtaatttgttatgctgcaatagacaacgaatactgtcaggaataaaattagcacatcaaacttatattggtattgtgtggtgggtacacaattgctagaagcaagtccaaatctcacctctaggtctggctttctctaaagagctaagcaaagagagacactgccatgcccaagaaacagtgtccataagatagatgcaactgaactgttgaggagaatcagggcttttctccattttggagctggaagagatgtttcccattagttttcttaaagtgatcccaggtgatggattaggtgatgtctaacaccaccacaagaatgaataaatgcatatccagggctcactctcaatggataacatctctcagtattagtcattgccagaataaagcttgagtgtttttacaataggctacaaaaactataaacacacatcattctaatggtcaagcttgactttaaggtaaaatttagaatatgcagagaggcatatggatgaatggatgaattctaaccctattcttaataagaattggtgagtataaacttcaaggctgtaaccaaaggcaaaactcagaagtaaagatattttgtgttgcaatttgaaaagagctccataaattttaaaatcaaaatcattttattaaattaggtacaatattagatgctcagctcgcacaccgatctagacaagatgccacatcaggaagtaattttagaaagtggggaagaggtgagcatccccattctccagcccagggctccagccaatgtcaacaactagtgatgtcctgtctgtcattgaactacaggcaggcccacagacctctagtgaaggtgtggagtctgtggtttcagttgtagtgagttctctccttgcaactgctcattgtatcccaaactggaaaatgactataagatgttcagaaatgaatagtattaggttatttttttttttacctacctgaagcacatgtgccctcaggacaatttttacttcttccaacccaaatgaccttgaaacaggaacgtttatttcacgtgctgctaatgacaaggtaataactgttcaattaaaaagtgttatgaaatctctcttttccttttaaatcccttaaattttctgcaaatgtgatttttttctgtcatacctgtctcattgacatagctgatctcctggagtagttcagaaacaaactttctgtttacacagcctatcaggagcacaaaacctcgttttctgccctgacttttccctgatatgaccaaagggagcacgaaattgtggggatttgtggagagcgatttgtcagccttttcttatttacttggactgtgagatataaattgaatttggggctctctcttcaagaataagttatttgttatcaaataggataacattagtggatcggacgtggataagttgtttctcttataacctcgttaggtgtgtgagggtgctctgagttctagaataatggtttgcttttctgtgtacacttggctttcatttatgactatctcatttgaacacccttggtctgctggatagtgaatgtctttccacataaaatggaacagactgaagacagcagaactacttattacagccattttaacagacatggcaggttttcacatggtttcctcagctattgggattattactgattgaacatacagtctatgagaactgattaacaatgtcacggctactagattgcttggtgaactcacttgaccttagtggtaactgtggcacgatggtgcttgagaaatcatcaaaacttaaaagaaaaatgagaagataatggttaaaatatgaattggtaaatgctaatataaatcagctgctattcaaattccttagttgacttgttccctatttaggtagtgactccgtcagatatggaaatgttgaggcatctgacattacctccaatgtggaaaagcatccacacatatggaacaaagaattgccccaaataacaaaaatgcagctgcaattacagaacaaacacgttgcctcctatatctcagcacagttgtttctgttttatggtacttatttatgtagtgactaatctgggatattcagtaatttgcagtggggcctttcatcattagtgcgagttaacaaaatggttctgttgtccttagtaattaatttggtaggaaatgaggaagatacaacacattctgagggctgctcaatacctttatcttcctttactgtctgttagctaaatatggaattttaatttcctccctaattatcaaagagtcttttgctaaatgggcatgtccctgaggcccaattgcttacttttactctctagattttcacctcactttttggaaatgcattcttatgaacttgcaagtcgttcacaaacatttctatggtaaaaagttaaacactaaccaacattaaacagctccagagtgtgttgagccttctgccagccccttcactgatgtcatttcatttgttcctccgggtaacccttcaagggtggcaatgaagggatgtggtttgcaagaagaaaactggcttgttgaagcttcttcctcaacatcctgttatctaggtggagaaactgagattcaaacttagttttgttttgaagcccacagtgtggttggtctggctctagagcccacattcgctgtgaaaaggtaacattactgtacttatcctgagttggtttagctttggcatctcatcagtgctgctgctcagttactgcttgtcatatgatgcctaacagttttctgagttttaccttggcatggaagattggagatatgcaaacttgcatgcctttatttcctctagactttgccgattctatggaaaccaaaacgattttttatatcaaagtcgattagcatttttcagaacaagtagaacacctgaaatttaagttaaaactgtagctaccatttgtgtctgcattcacatcattctaacaatctagatgatgccttgccatagttaaatatctacattgccaacatgataatgatgatgacagtaacaacagcagctactctttactcattgtgaaatacattctaggctgggtagttaacgattatcgaagtttttcaaatgagaaaaatatggtatagcacagttaagaaatttactcagggtcttacagctagtaagtggcagtgttaaaccaatattttaaaatttgctcataattggttaacatttttctgttttcttggtattagttatatgtacagagtgagtatcctttgaaatgtttggaatcagaagtgttttggatttttttattttggaacattttgcatatacataataagatatctaggggattggatccaagtccaaacatgatattgatttaagtcttaaatacaccttgaaaacacagactgaaagtgatcttacacaatattttaaataatgtgcatgaaacaaagttggtgtacattgagccatcagaaaacaaaaatgccacgacctgagccacccatgtggataatctgtggttgtttggcatcaccgtctttcatgactgaatttatgtgctacctataagcaattttgtgtatgctgattcacacatcagtacttcacagtcacaaatatgacatactgttaatatagtgtaaaaacaatgtgtgcaggctagctaagcagcacagaagcatcaccagatacctgtatcagctgctaaccaacagcaacaacaaacaatggcaggtgtctgttcttcagctacaatgctgtgcttgattaagcacaccgtacagtaactcccttgggaactgtgaataaacggtgtgttgtgcacctgtgttttgactgctacccatcacatgaggtcagctgtgaaattcccgcttgtggtgtgatgttggcatgaattttggagcattctgaattttagattttctgattaggaatgcgtaatctgtagtattctgttctaatgttggtctttggtgttgcaattattgtgttaagattttgtttggtctatcaaaagtcataatgatgactactgaaatgattttgaaatcagtagttattctttgtaaaaggaggattttgaagatccaatgtcttttatcaaacatctcaccagtaaattaagaagatctaaatcttgccacacacacacaaacacacacacacacacacacacccttatgctttaaaatctatctttccaatgtggttcccactgcacatcttgaggggatcttctctggatttccacataagcattgttcagaaaatgcttttcaggcagagctttgtcctccagaaattccatagactagcaggttgtaggtaccattcacgtggataaccagctctgagggcaatgatatgaatttagattaaaacaaatgaaaataccatctgttttgtggttaggctattcatctcactataatggtagaccatctatagtcatctatgcttggctttggaaggataaccctgatcaacacaagtattaaataatgacaagcccctaaatagttaaagcttaatccaaattgccaattacctttccaaaattttgaaaagagaactttatagaaaagcttattaaatatggctaaaaagaatgtttttggtacagaaggtgcttttatccagtagttttcaagaacttcaagtacacgtttcaattcatacatttcattcatgcattacacaaatacagaaagtaaaaattataaagttaaatctattcttccagcattcctaatgaattcttctgtgatacctccttgctggattttcacattccaacacagagaccgttggttaatccaaacttttgccttcacaaattagcccacatggcttaaatttaagaacataatttgtttttttgtttgtttgtttgttttagttctaatcttagcatgttagggaaactgtggggtttctctagaaaagttacaaataaaagataagcctcttattttacaaattcctcaaggtgtgatacaaacttgatcggagcaaacacttccctatcaatgcaatggattccccatataactcccatggactgtgtgtgaggctcttgtcagagagatgatccagtcagaagtcagaaaaaagaaaggcatttgaatggtatttctttgccaattcatattcaccgcctctaaaccctatactcttattttctgctggaagtatgaaaagggagggaataaatgtaggaagaaaggaaactgcgaaaatagggaggaaaagaacagagaagaggagagagtggaatggaaacaggaacaggacatttctgaagggtattatccactcttggctaaggtgaagtagcagctaattaggctatggggagacccagagcaccctcttttcttttagcaaacccccacgagcttatggcttttcccccagctgggcaggtttcctattgaaatctgtctcctggaggactctggagcacgtctctatctgaaaagcctcgtaactgtgaccttgacaaacatcccttgcaggaccttgagagatggtagaaaatttagagttttgtgatttacatgctgcagaatagatacctattgatcttttttttccttctaagaaaatgttcctttgatacattctggctgaagaattggaaaatatgggttttattttgtttcgatttgatttggtttttccaaaggagagataatcggtgaattccactggggatgggtggttgtttagccaagtgtaatgttccataaattatctgggccttgaactattgccatgtatgatacatgagtgatacacacaacccaaaaaggatttattctttattttcccacccagtttcagagggagaaaataaccaggagccaggaaatagtgataataaacttcactataccttaaaaaccaatgttattctcattttcattaaaggacaatgaagctcatgaaaataatccacatactgatactattcatcatcttcctcatcacaaattaaaaatgatgctaattaaaaaggtattcatatatgtaaagctgttgtttttagtctttttaaaaaagctcataccatatatatgtatatacgttttttcagctttactgaggcataattgccattttatgtatttaatgtatacaacatgatattttgatgtatgtatagattgtgaaataattacacaatcaagccaactaacatattcatcacctcacacagttgcctttttctggtgtagtgagaacacttgagatctactttcttagcaatgtaagtgtacaatacattattactaactatagtgaccatgctatacagtagatctccagaacttactcatgtgataactcaaagtatgtatctttgtcttagccttttttttttagtggttgaaaagaaataatcaaaagttagtttttttctgccttttaaaatttactgtttttaaagcagcacaaatataatatttgataaatgttacttttatatatgtgatttctggcatatgaaaataatctcttgttagctgtttttaaatgtcttttttcttgatgctagttgagatttaaaggagaatttaaatgtaaaaaatctagaacagttatctcaagaaaagtgcctccagcctcttaagccattatttacatgaggaattgccaggagcagcagccattgaatgcgaagcaagaggctgctctatgtgtatgttttatagttcccctttgaacctgtctaattccagtgtgaaaataatgtttggctctttattagctaatttgaatctactttgtggtttatataaaatacattctcctaggagtttataatccaggaaatgttcttgatactttgaaactcttttggggagacatgtggttacttcattgaggactgcacttcttcgaaggagaatgtgaccaagttcgctgctctacaagtgctagggagagcgtggaggcgcactcagtgaaatgacaggaaacatacaatacccgtggcattttactttaatcccagattttcctaaaacagtcgttataaccaccttgaaaataaatcgtttaacattctttcccctattcatgaagtagggtacaatattatttaatttatagcacaagaattttgtgagacctggaaatattgataatacaaattaggaagaaaataaaaactctggcttatgtcttagaccttcaaaagttagaatttgtggaaaattaagtagcaaattaatttgtagcttgttttatttctctgtttttattacatggggatttgtggttataaaataattataaacttttagaactggaaagatcttagaaataatctattttacgaatgaggaaattaaaatcaatatacgtacaatgatgtgcccacatctgcacagctctggaaagttctcttcctgttgaatgtatccttttttagctttcagggaagatcgaaaatcataattatgcaccctgcctcctctgttcaaatcccactccaaccttacttatgacttggagtttggcaaaaacttccatgttccaacaggaccttgcctccctggcagtagtagattaactagggatactgatggcgcagtaattccagggatgatcaagagagccaacaatgttgagtgcttcccataagccatagtctttgaaatccttaatatgtgtgagtttgtttaaccctcacgacgatatgctttgggatagataccactatcatctctattttccaaatgaagagcctgaaatggaagtaagtactttactgaagcccacacatatggtaggggcagggctgtaattcagtgtggctccagcatctgtgcactacatagcaggcatacagttaggacaatctgaggacaattattggcccaaagttgggcacgggacataagccaggccaacaggagctatttcctggaatttttcaaacagaatctagagaatgaagtatgtttctgatgggcagggtgagagatgtccaccacaattctgtcaggccatatttcctgctaggctgaggaagctcgtcagagagaaggaagctaacacatgtgaggagtagagattggagaaggcgagagtgtcgtgggatgggcacctggctgcatacctgctgttccctgcaaagcttttagtcgattaaatgtttctcccttttcttttttatatgtaaatcagaggagattgcctaattaaagtaattattgataagagcgaatccctgcttagctcttactatgagttaggcatggttataagtgctttttatctcatttatatcacttaatccttaagataatctaacgcaataagttctactttcaattcccattttataaaggagaaaacaggggcacagagaagtcacttgcccaaaggtatatggttaataccgtgactacctgctgtagtcaaactgaacatgggactgtttgactctgaacttggttcttagctccatgccccgtattccccacatgacctagaacccactgcatggagatctccattaacagtgaaaaccaaaaatctttcccaagtgattcaaaaatactaccagagacagtttttatatctcctctatggggctgacaagatttaggagtgacagtttgctgatgatattaccacagtaaatacttgtaatatcaatagtgatcacatatattttaaacattagccatttattaataataatgatggtgactattttttctaaagtgcaatgcaccttaaaaaatttaagaaaataaatgattctgatttattttcctcaaattgtgtaagaacatttttatggataagaaaatgataacttagaaacaattaaaacttgaaataattattaaataaattggacatgggtttcactgaaataacagttctggaagttcaacctaggcttttcactctcagtcacatgtgctttctcacaaggcactggaaaagcgtcatgcaaatacaaattagtctcatcctaaaaggcaaagtaaacagcaaaacatgtacccagtgaatgtaatgagcagtcacactgaagctcaggcttaagctacgggaaaactctttttatcctttagcaataaatcctgttttgactgaattatagtatttggataattgatccaattctcttcacatgcgcatttattattagtgttctatgtggtctagctaaaccccagtgattcatgaagagcaatcataaccacagaaataaggctccaagatgtacttccaaagcacaggccaagcatttgaataagctgcagcctgcctgtaccattaatcttgcatgctgctttgcaagtgtgttctattggattatattcaaggccatttcgccatgtgttcaactagactgcaaattctttaaaggatggacctcaaaggggtatcatgaaggaaaacatgcaatattacaaagtgcttagctctttataactcttctcttgcttttattcattcaacaactatccactgaccacctccttggtgccaggcctgaggttctggagatataagcagtgagcaagaagtggacgtgggccccatcccaacagagcttacattctcagggagggaagcagcccataagcacactagcaagcaagcaagcaagtaagtatgcaacagtaattagtgctcggagggaaagtgtggcatgcagtgcctgagatccatccttggagaggagatgtggaggctgaagcttaaatgctgagacaagctggccttatgaggatctgggcaggaatgttctgggtcccaggagcagttggggcaaaagcattgtggttgaaaagcacttgcttcatttaagaagcagaaaggatgtccatgtggctgtggaaccgtgagtgagcttgaagaagagtgggaaaaatgggaatggaaaggtagaagagttttagaaaggggccacatggtttatgtcctaaatcagaggtagacacactttctctctaaagagccagaaagcagatgttttggacttggtggactgtgtggtcgccatggtgactactcagttctgcagctgtgatgcaaaagcagccacaggcgacgtggaaatgaatgggcatggtgtctgcgaacacagcctaatttattggaacaataaactgggaattttatttttaaattttaatattaaatctctttaaaagataacccggcctttatggaaatatgatgatgatatgataaccgtgaagagtgcacattccctgtgcagttcaggcagagctctcagtgcggggtcaagttcaaagaaacgccaacctcacaccacaacgtccttgtaaagttgttgtaaatctgtatggaggtacctcaaaaaaatgccaacaaaggctcccattcataataaacaagccttcctgaaatacttgtttattacgtttttcacttatttcacatacagacagagctgtcgcctagctcttttcttcagttttaacttatttgttattgatatgtgatattgattgatatcaatgtattaatatattaatatacaatatattgtattaaaatatcacatgtactccaaaaatatgtataatcatacacaatacaatgtataatgatcgaatcagggtaattaggatctccatcacctcaaacattgatctttcccttgtgttggtaacattcaaaatccttccttttagctatttaaaaatatacaaaaaattaccataatttccctcctgtactattgaatattagaactgatttcctctatctctttgtatttttgtgcccattaatcatatctctttatctgctccactccacaccctttccagtctctggtagccatccgtctactctctagctccgtgagattattatttttttagctcctccacgagtaagagcatgtgatatttatttttctgcacttggcttatttcacttaatataatgacctctagttccatccatgctgctgtacattataagacttcattcttttttatggctgaatagtactccattgtgtatatgtatcacattttctttgtccattcatctgttgatggctactgaggtagattccatttcttggctattgtgaatagtgttgcatgtcgcctagatcttgcttcctctctccaaacttccccacactcaccaaatccagcccaggtggactttaattattgtacccattaagtctttggaatctattgtttccctttataccaggagttttcagtgttcactgagtccactgctttttgaatgatgcccagtcctcaacatgtcccctttttctccttccctattttagtttacatgaaccatacatacagttaattgttttcaaacacccaaacctcccttgccactttctcaatgtcattttcgccagcaaaatacgtaacttggtcaaacccaactgtctgtgtattaatcgtggctggagaacaacgcacgccctggctggctgcattctgtctaaaaccatccataagtctccagtggcagtttccatgaccctacaatccagacatctttgcctgtacagtttaacttgctcactttttgatacaattttctgccctttttttttcagatatttccaatggtttaaaatttcagcgaattatcttgtcacatatgtaattgagagaatggaagttctcagaatgaaactttctctttgttcaccatcaaatctgtctaaatacttctacttctacccacacactttgtcttctcttctgtgatggtggatgaggatccccggctcccatcaaaggcagttcctggctggtgctccgtatgttgcccttctccacttctagggactttgactcagcaaataatgctcccttttctgcatctcagtttcccatcctcttctgaattattattttcagcttgttctgtagattcctggcttaagaaaactctcccttgagcacactgacccatgtcttcctatagctactggcccatttctccaattctttgcttcacattttctttacaacccacagtgtctgagcttccattacaccactccactgaaactgctcttgtccaggtcaccagtggtaccaaagatgccaaaggcacctgtggtgttggccaatccaaggatcacttctctctcctggtcatactttgcctctcagacgcatttgacatcaattcaattccaaagattcttttccaccacattgcaattctatgctttccttttctgtacttcactgatcactgcattcttctaagtcaaattgttgtcacctctttttgtgctgagcacctaaatatttgggtctcagagtttagttctaggtcctgtagtcttcagtatccaaactctctcactaggatagctcatccaatatggagctcttaatactatgtatatgctaataatgttaatatttataccctcagcctaacccattcaaactcatgtggctgcctgcctatttgacactgttgcttagatgtctaatagacagctcagttaacttgcgcaaaaggaaactcttgtcgattttttaaaatccctaaattgattactcctcctgtctttctatccacccagttattaaagactaaaatctagaaaccatccttgatctcttttaccctcagattccacatctaacccaacgttgagtcttgctaattctatcaccaagatgtatctggtattggtctacttttcatctctatggcaacctccatactccatgtcatcatcatcaccacatggaatgcaaaagcttcctaatcagtgccttgtttccactctcgctcccattaatctgctttatcttctattttgtttttgcaagctagcataatgcttttaaatagcctgaagcagatcacattatgttatttctctgctcaaaatctttcaacggcttctagtgccttttgattcaaatgaatcaaactgaaatccttcatcagagcatacaggaccttgttttctctccatctttgtctctactattgtcagtcttggtcactgcaatctaactagtaggtactagttgacttggatcatttccgtatcacctccctgccaaggcatccacagaccactcaatttaaagtaattcaatcctagtcaagttttaatattattattctgaattattttaatattattaataagactattctgtattatcttaatattatttttctgtattatagacttctagtctttagtcataactgaaattattttatttacacaagtacacaagagtggagacctcatctgtttaggtcctctgtggtattccagcacctagaactatgtctagaacaggatagagagtcagtaaatgttagatcaatgtatgatcccttttactttcctagattctccaactctgcatctcttacctttacatttaacctgcacattaaaggcccaaggattggttgagcagagacagacgtctcctctgcacacagaaggtaaaacatggccatgactgtattaatattttactctagtaattaataaagccataatttatggagttttttcatgtgcttttatccactctctaatttaccctgtcaaccaccttggaatgtgtattactggaaatctagtttttgctgtatgttttccccttcgtaaggggactgccctttcctgattctgtgcagctctctggcacctccaggtctggtggaattgatcttgcttccctggaccaaatgctggacccaccagctggacagtcagggttcgccttctgcctggaaaccattaattggttcagggatggtcacatgatccaaatatgactaattgttcctctttggaaagcttgttggaaagagcagggaaattgcaatgtttttttctgacaggttcatgtttaaataggacctcacatattacggcctctgcctggaaatgaagctcatcccgggaaaagaggcgtgagtgatggagagcgggcgtgagcgttggagagcgggcgtgagtgatggagagcaccctcgtctgagctcacggacaccgcctgagtgaaccggtgctatctttggcacttttcacgaagctgtggtaataagcctttttgtacctaaactaatttgaattgcattccacaaacccttgactaattcgattactattcttattttataattggggaaaatgaaaagtgtcttaaagttaagacacttgccagggaggaaatatttgagcaagcctttctttggtaaatagcataggtctaatatggactagcgttttaattattttgatgatatttaaattttttccactttaaaaacattttattagatttttttttctcttagtgtatatacaaaattcacgcaggaaaaaaccatattactttaagataatgctttggattatgtattttttttctcaaagctcattatttagtcaatggaatgaagttcagtaaattaagaattgacagaaattggaaattatgtaaaattatacgggtgtcaagagaaggattaatgaaatttagtagttgatactcacaattaaagtaaatgtgcaaaattgggtactttaccacgagagagcactagctttcaggaaagtaaaacaaaaaatgtatctcctctatattggctgcattctaaattacaaagattgaacatgaaagacaaacggacttatgggttaataaaaaagaaaaatacgcccattctcactttacactattggtaaatattcgagtgtacaaataagcaaaaggaacattagttaattcagaaatgagagcgaactaactgaaatgttctgtgattgatgggagaggctgatagaattcacaggttattggaatactaattgcaccacattggcggcctcgtcaaataccattttgctttttatagatggttatactgttcactcacttaatcaaatcagaaaacttggtcatcttagattccccactccttttgttcaccttccctgtctttaccatttcaaattggctctcttgtcttagagcttatgtctctaaaacaaccatggctgaacgctgccctggcacagtgtgtcttccttgtccaatctcagggtctcatcttcgtgcatcaggctctgtctattatagtccagcctacatagagctgcaaagggttatttaaaagaacacactgaattgcaccacgtttatgcttaatactcttgaaatatctgttacctgaagaataaagttcaaaaatagggtccttagagaagtatttatttgttaggcattatagatatttgttaggtactatagggtacaaggaaagatgaaatatgggccttcctgtaaggaatttgcataaggttgtgtgattgggagggtggggtgatatccaaaggcagccatcttcacggaaagcttattacagataaggaccagtacaacgaagctcaaagggatagaacttagcattgcctctgttttcagaaaggcttcctggaggaaagatgccaagttgaggctcaaaaagtcacctaggctcagaagaaaaagaagtgtagattattatccaggcagttataaaagcaggaaaaaaggtacataaagtttctcaataacggcaaacagttcagtattatgaaaacataaacaatgacgtaggaagctgaagctcagagggatggagaaggaagtaggattgaagggttcatgaagccctttaacctctactgattgagtactctgctgaggatacagaataaaccagaaaagaagctcacccagcttctctggagttagcaatctatagtttaagggccaaatacataaaagcagtgcaagttctgataatgctatgaaggaaaatgtaagttattgatataaaaagtgagaggatagatctattttaaatgtgatggccagggatgggctctctgggtgggtctcatttgaaaacgagaagaaactagcacatgcaaaaattggagaaggttctattgcaagggccctgtgctaagaaagagcttgacttcttgaagaagcaaaggaagaccactgtgcctatcaaagcaagtgggggtgggggaagcagctagaaatgagattgatgagctgatgagggaccatccttgcaaggccctggagatcatggtaaattatatggatttcatttcaagttcagtgagaaacctttcaatgatcttaaacaagctaaacaagcaagcatacaccatggtatggagtttgtatatcttgagtaatggggaatcaataacaggttttaatcagggaagttcataatcacatctaatttgattcactgtagaggttggatgaagagtgttataaatgtgaaataagagtggggtaaaatgtattgatcgggaggacattgtagttatgcaggcaacagatgttgagctggtatttgtacagagaaaaggatacaattaaaaaacattttaggctgggtgcagtggctcatgcctgtaatcccagcactttgggaggctgaggcgggcagatcacctgaggtcgagagtttgagaccagcctgaccaacatgcagaaacctgtttctactaaaaaaatacaaaattggccgggcatggttgcacatgcctgtaattccagctactcaggaggctgaagcaggagaatcacttgaacctgggaggtggaggttgcagtgagccgagattgcaccattgcactccagcctgggcagcaagggtgaaactccatctcaaaaaaaacaaaacaaaacaaaaaaaatgttagagataaaatcaccaaatgttgtgattaattatctgaaagagtgaatctaataaaagagagaaagtagtttagaagaagagttgttttttatgacatggtgaataataataccatgagctggtattagataacacaagaaaagggaagatttggaggagatcattacactatcccttgaattctgagagtttgagatattgtggaataggcaagtggttatgggtagatggaagttggatgtagaaatctaaaattcagagaagagcaagctagagagacaaatgtgaaagacatcatcatatatatatttggcagttcaaatcatgagtgaatataaaattactcatgaaaagaatatagaaagagaagaaaagtagaacaagagctgaattttgaaagacatcaacattaaatggcaggtagaggagggtctgtgttccgagacagagaatgagtggtaaatgagggaagtgaacgcatgggaagccagggaagtggaaaggacccagaaggagaacacgcatgacacgcaaatgcaacaggagatccactgagataaggatgcaaaagggtcccagggaactggcaataacagggtcagtgatgtttgtcagagcagggagaatataatggtgggacagaatcgggactgcagtgggattaggcaggaggaagggagatgaagtaattctaggaacatggatcagtcttcatgaagggaagggtagaaaagaaagcatggtggctggtgaggggcacccatgtgtttagttcttttaattatgtaagacatttcaagctttttttagactaaagggaaaacatgagaaaaaaggagagattgatgataaaggagataattcatcaagtatgatcccagagaacaagcaaagagcttggaatcagggtccctgaggagagtagcagagaacaccgatctggaagtagggtcaatcacagaggaactttgagggactgacaggtcagctcttcagcacagagccaggagtactcacactctgccccagtctatcttaaagcctcttcccaccactctcttctccacggattctcagtcctttccacacctacacgttctgctttaactaccagagagccaagtctccaaggaacaccacacactttcatccttgtgttatgccatggtatccatcttcttcccttttaactcccctccccaaatctactctcttgccctaattcttagtccctttgggctgcataacaagatatctgagactgggtaattaatgaagaaaatagatttattgtctatagctctggtggctgggaaacccaagatcaaagcaccagcagatacagtgtctgatgtgggcctgttcctcagaaatggcatcatcttgcagtgtccttccagggtggaagaggtaaggatgccccccctcccaccagaagggaactaatctcatttgtgaggttgggaccttcacgacttaatctcttccaaatggctcacctcttaataccattgtatcaagtattaggttacaacatacagactttgggggccaccagcatttggaccataccatctaactttggcctaacatacatccctccagccaaagttaacatggggaaatattttcattatacttcagatcttataaaaatgttttctcctcctagtcatctagatgcacacataaaaacaatacttcctttcccacgttcccatggatttgtttgaaacctagctagaatgggacctctgtgaggccaggagttgtgctctatttatctctcatctttggtgtctggcacaatgccaggcgtatgcctgacattgtattgaaggacaggacgcatatctacagacttcatgttaaagatggaagccgtgatgtctccccttaaaattattcctctaataacttacataccttctgtagcttagaaacttaaaaaacatgcttagtaatatgcagaaccccttgtaactctacttgatggattctctcctcttttgcatcttcctattacctcataacatgaagctgaataacagccgtctatgtgtaattaataaaatatgcaaatattttgtatcattatcttcagcttacaaatcagaatgaaaaattgttgtatttaatgtgtttggttgtgcagctttcttcaaatgcctctcctctccatgacccttactgtgaaaattaattgggtatctcctctgactgctccattcattcatcaaacatttattgccaggcacacagataacagtaagaatagatcttccttccaaggaatgcacagtctaattgacagcagtaggaaataatgacaaaattgttttcttttagtagaatttttatctacagagcaaagaatcacaactctagatcattgccctggaatttctctgttggagatcatccccagatggttaggactctgtctgaaggtttcctgattctgcctttggttgttgtgtgcaaggcatgtgagatggtcttaggtgaactatcctggatgggagctgatgccttcctctgcttcagcagagtattctaggtgcagggtgagagaataggcctgcattttccagcactcaacaatcctgcaagggacgaggtgaggttcctgctcctgtatctactactttccttgtttttctctgagtgaatggaatactaacctaattggctcagaagaagaagactgcagtagaagactggctacatttacttactaaataagtaagtctcattggcttcctacttcatgggacaggctcggaaagaaagccagcaggtatctgtccttgctctcttcttttctttacatgtgaatgctggctgctttcattttgttgtcatcttgtggtaagattcgttcttgggagaaggattagattattaggtctaatctaagcaacctgttccagtttgatttacaaatagttagaatttggggtctagcccaattaataatgaactggcatttggatttacctttcatctgtatcccttaggcattccattagagaagggtggctgtgccaagacaagatttgggtgtctgttagaattctgcacaaaacaacatcttactgcttttgaagccactctttaaagccttaaatgctttcctatcaatggggccaacaacaaaaatatacgttggttatagttttatatatatagatgtaattataattgatgtataattgatataattatagaaccaaaaaaactagactgacacacaattcattaaatttttcatctgtcgaattatttcatgttatatgtgactgatttaacgatgattagttatttatatgggattctttctcctaccccatcgcaagagactaacaggcatgacccagttgaatggagtctctgcttggaggccaggccgtgattggagacctaccctcacacttataagaataaacacttcattggaagacttctaagtcgttcagagaatggaaaccaattatttctcttctgggagaaactggtaaaaattggactttaaaaaaattacatgtaataggagctcttgaatagagatattgttagactttaggggtaattatcaaggaaaatgctcagcttctttcattaaagactggtaaaaactatcatggttagacagagtttttcctgaaataaagagaataacttttataaattttgtgtttctttccaataccatgatactatgccatattaatatttctatgactgcatttggtaccatctttactatgaaaaaatatagtttaaaaaatctttttttaatcaaatatatgtggtaatgaaagtttgtagtctagttttccttccctggtacagttaatgatggtttcattacccaaagaactcaataaaccaactgtttcattatgctgacaaacaacttgatcaataaaactgctaacttcacaaaatgcaaaggtttctaagtgaggggagagaaaatgtgattctacacatttgaatctttccatatcgattaagaaaaatccttacagccccatgcatgtctccaggaaaaattatgtgtgtgcgtgtgtgtgtgtgtgtgtgtgtgtgtgtgtgtgtttgaggagctaaaggataagggtcattaacttccataagtcactcatactatatagaaaataagacgtcaatatgattctgtataatacaaatacatacaactatctttattttcttggagaataacttactttagttatttctttaatctttgaagtgcttcttttcaagtagttaataacattttatgattgtatgatggttggcaaatttgcaggtagctgttacaaattgtactttttatttccactctcaacctaaaataatatataatttattggatgattattattctgcaatttaacattttctaaagattggctgttttacaactgtatcgatacttaatacagtgatgaaaagttctcagtatgttagataagaatacaaatagcaataacacaaccttttggcctctgagcctaagttgattttatgaagtccttctatgttcatgaacaaagcactcttgtccctatcaaagactcacttgactttttccatattctctttagcaaaaatgaaccagtaatcattgtggcaggtaggagcagtagccctctgtgcagtagaaagtcgacctatgggccgggccccatggctcacgcctgtaatcccagcactttgggaggccaaggcaggtggatcacctgaggtcaggagtttgagaccagcctggctaacatggtgaaaccctgtctctaccaaaactacaaaaattagcagggcatggtggtgtgagcctgtaatcccagctactcaggaggctaaagcagaataatcacttgaacccaggaggtggaggttgcagtgagccgagatcatgccactgccctctagcctgggtgacagagcaagattccatctcaagaaaaaataaaaaagtccgcatatgacttttaacttcttaaaaactttactactcatagcccactgttgactggaagccttatcaatgatataaacagtaaattaacacatattttgtatgttatatgtgttatatatggcattattacaataaagtaagctagagaaaagaaaatgttatttaaaaaatcataaggaagagaaaatatattcactattcattaagtggaagtggatcatcataaggtctgtatccttgtcttcatgttgagtagactaagtagaaggaggaagaggaggggtttgtcttgctgtctcagcgtggcagaggcagaagaaaatttgcttataagggcacctgtgcaggtcaaacctgcattgttcaagggtcaaccgtatagcgaaaagtcgtggagaacaaggagcatgctggatattcatttaatccaggatattcatttactcgcccattccagatgtttgtatgtctgctatcatacgtgctagatatccatcttatacttaatgtgatattgcccacatataaagttttaagcctttcagtgtactatagtagtcaatatgagtgctaaataaatacgaatagttcatatatttatacatgaacatgatatgtttatgaaatgataagagaatgtggagactgtggatctgatgatcaggcttagagacagtgaagtgatttaagataataacatctttcctaacacaatgaaaatggaaagatttacccaaacccagacgaagtatttagaatgttggaaggaaacaaaaggtcatttgttttcttacacttgtactctatccacttcaagatcggaaacaaaaatgataaagagatattgctatgttgggtcatggagtctaaccccaaattacacactatctttgtcctgaacatgattcccttgttacggaactaaattcctaccggaagccaaatcacccttcagtagtaaattaagcactgaggaatacacatattttgttttacatcctggaagaatcccatgcccattgtgtgtatcgggggtgtgtttacatagtgggcttcaagcaaactctacaagattctgctcagctctgctccagatccttaccagacacccgagacccaacctgaagagctgcccgcatggtaggcctcaggccatacccacggcctctctagttttactcctgcagtgctgagcgaaccttactaatctaactggcactgagctttgtgccagacctgggggtagtaacaaggctgttagtgtcttgaggagcttttctaagtcatgatcataaacaagttctaaagcttgggtctccaaaaatcaaagaacaagatgtatgttcttttccaaagagaaaatttgtttcctgtgctgcagagttgctgccaatagacacttttggaggactacacgaggctgcgcatttggattaaaatcagagatattcatttaatcacccattccagatgtttacatatccgctctcatgtaggcttctccaaaagtgaggttttaataaggaagagagtgtttagacagcactcacctttttctccatgacttttctctatacagctgacccttgaacaacgcaggtttgaaccgcacaggtgaccttatatgcaaattttcctcttcccctgccacccctgagacagcaagaccaacccctctccttcctcctcctcagtctacttaacatgaagatgacaaggatgaaaactttatgttgatccacttccacttaatgaacagtgaatacattttctcttccttatgatttttaaaataacattttcttttctctagcttgctttattataataatgctgtatacaacacatataacatataaaatatgtgttaattgactgtttatatcgttgataaggcttccagtcaacagtgggctatgagtaactaaggttttaaggtgttaaaagtcatatgtggactttctaccacacagggggctggtgctcctaccctggcacctccccaccattgttcaagagtcaactatacatggaagtttagtgggtttggggctaaagaactatagagagcgctatgaagattctgactgtggtagcatttaatagcatatatcaactgccaaatactgttttacttagattgaaaaatctcagcctaacatcctgtggtctctgcctttcctcatttccttctacctcctactctcccccagcctggagaccttcccacagtagaattactccacttgacattaaggattttatttggtttcaagaatgcttctctttttttcctttttccttcccttgtcactccctctgtttctctttttcctgtcttcctttttatgtgtctttattttaatattcacaggagcaggaagcaagttctcctagccgcacgtggaatgcaaatgtccaaatgttgcgcgtgggaaataaatcgaatttctgagggttaaacgaaggtcagtttgaacatttaaaatgtctgaaaataaaatgcaccaatcaattctattcggatgtgtgtgtgtgttaaacatcattttagcatcccatctaagcctatttgctcggtttttctgctttgttttttcttgcacctcagggtgatggcttcaatagctcgtttgcaccaagtagtaacaggccacagcgggcgaatcaaccttttgtctgcctcatcagactctttgccccattgtcccccctcagatcccatcagtatggggaaggaggcccggccaatgctggtgaaaacagaatcattcctgtaacagagagggccgttcctgcactcagggtgtccctgtgacttctggcttctctggacccacggtagcatttgctggcgatagaaaagcggttcttgttgggttattctcactggtgcctgcagagtcatgaaagcagggaggacagcgccgtccacctcctgcacacagaagtctcagctggaagtggcggtccccgagagcctgcgctccgcagcttgttttagccttcagaaaaaacgctttctttctgtagcttaactgcttggcccacagggcagccagctgttgtatgctgcttgagcagaggtcgtggaggggtgagtgagcacagggaaaccttttaatacatattttatatacttcagatcactaatgggagctacacaaacagatccatttgaatatctaccccctggggctatatttctgtttcgagttttctggtaacagcaaggatcaaaaactaagatggttcttttaaacacacctgattgaccagaaatatgcataaataagtattctgcactactgttgtatattttattattcttattatgtttcctttttgaattcttttttaagctttattgaggtataattgacaaataaaaatgtatttaacgtgtgcaacgtgatattttgatatatgtatacattgtaaaataatcaccacaatcaagctaattagcattaaattgattttacatacttttgattccatatattttaaattagacaaaaaattagccttggttttgataaaagaaaaacttcagctggattaactttaaaggcgtctaattgagtgatgaacaatttgtgaatcgggcggccttctcagccatggtaagctcagagaccccagcgcagccatgcgggggaagatttatggaaaaaggaacatgaggaacagaaaacagaagtgaggtacagaaacagctggatgggtggcagctcggcgtttgccttctgcgaacacggtttcaacggctggctacatttgattggccgaaactcggtgactggcacaggtgtcggctacggtcggttacgcctccacctgttatcgttcacgaggtgcagaaaagcctttaggccgaacttaaatgtgtaaggaggcagctcagggctaaccttgatttaacagtttcacacatgtcaacaaaagtgtaaacaacatgatttaagcaatagagatgagaggtcatctcagaagagaaatggcatttataagaaccacttggcattaactatatttttgtagaagatggcttttcttatggtattattttaaaagtgttcaaatgatatcaaagctgccattgttaaaagtaaaaaaatcctaatgtggatacttacaaatgtctaatatcctaatacttcaataatgtcccagtactttactgtgtaccccaaatgttatgtgtcgttttataaaatgattatataatcttgctggggtgttcttgtcactcaccattacggaagagaaagccgactcggagaggagtggccatttgtccttcttcacagcattaataaatagtagacccaggaccgagagggctgtttttatatccctgcaatgtttcgtatgtttgaaatgtgttgattgaaaatgttcttcctctttgatgaagaagagccacagtgaccgccaaagaaaccgatttagaacagtttcttctaaagctttccgcttggacttgaccgtgggtgtgtctgaatgtttctgagccagctccacaccaagcctgaatgagcccaagcaggtcacgaaattgaaaggactataaagcaccgtatcagaaaaggaggagaaacccaaggcgtatccgttagtggctgcatatgccaatacgcaccagtccacgcttttctgagcctgccagcatccgcagcctctcctgctcgcagaggttgtcagacaccccgggcttggctcagtcctgctgcccagttggaatcaaatctcaagagagagacaaacactgtaaggagtatgaccttctccagcaagacagcaaaggtgcaaaggagagaaggatgctacatagcccgtgtgttttaaagaaatgcaaatattaaacgagaaaaaaggagtattagtttttttaaaaaatgggagtgtacagatatgcaacaacatgagaaaacaacacaacacaaaacaactttgctggttcttcaattaaaatgtacacaatggctctaatgcaaatgattgccatattgaattggtcacggagttgaaattaaaactcatgactagtgatttatacattttgcttaaatcaccaaatacaagcaactctttgaattgaactgttttatcccttctactataaattcctaaattatacaaattccttcatttccttcttccttcccttcctttctcttttccttcctcccttctttcccccctccctccctctctctctctctttctttctttccttccttccttccttctttcttttgtctctctctctctccttctccctctttccacttagccatgctataaatagtaagaggtaaaagaaataaaaacagaaataattacaggcccaaatgtattattatcttcaaaggaaattacaaagagaagaaacaagagggatttccctccatcgtgtttctatacacgcacgatattctaactaaagcatgttacaagtgatctatgttatttttacaaaccaagtgagtggtttaaagaaaatggaaagatgtgtcctctaagaaaaccacagttacgtgagtggtaaatggaaacaacgagactcttaccttctaagctatggggtctgttagctctgcatcctgtatctcagtgactcagggcaggtcactaagcctccttgagaaccttgttttcagtattcatggaaaaggagggaagtgacccaggcaagggtgtcgactgtgaggcatattgcttatgtgcagttctattattcttggtgttagaaatctgaactctcatgtttcagtaaccggaaaatcttcagaaaagacatccccggcgccatggttgtcaacatgctcaaacacctcgttatagcattcttgccccttactggtgcaacttcttgctactttcctgtagttcagtgacagaagttgggggttattcttggtaccttcttgcaggtaattcccaaaagtcactggtgctctaagggacccactcatcctcacctgataacccttcaccaggaagcagcaaatgctaacaactctctatacttgcactcactctcacgacctgcccctgctgggcctgtggtcacccgagagggctttgctcccaggccatgggagggcacctgctacatgactcactaacttccctgtctggcacaatctgagtcttggtgcagacccttttccacaatccagactctagatagcagacatttcccagagcccatcctatttggttcccttgccgtgtgtattcctaaacaaaaatcatttcagtgcaaatatgagacactttttgatgtgtgtgtgtgtgtgtgtgacataagaaatgtaaaaagtgaatggtcatatttttaaaaagcaatgaaaatgggccgtatgcggtggctcatgcctgtaatcctagcactatgggaggccaaggtggacagatcacgaggtcaggagatagagaacatcttggccaacatagtgaaaccccgtctctgctacaaatacaaaaattagctggggatggtggcgtgtccctgtaatcccagctactcaggaggctgaggcaggagaatcacttgaaccagggaggcggaggttgcagtgaaccgagatcatgccactgcactgcagcctgggcgacagagcgagactccgtctgaaaaaaaaaaaaaatcaacaaaaatgaagagagtatattaagatctggttagacgtattaattagacctacagaggaaattcctaaagagccgtgcaggcccgttcttggagccctggaaatgcacgcatttcttgatgcctctgaggatgcccctctcactctctgattgtacttgacctggcagctgctgactccgtcctaccccggttacacagggttagaggaatgttaattacccgaggatgctgtgtcatccgcacagtatccgggagaaaataacaaggacaactcccttcatctgagaaatacagacatttagcgatataagtgccacgctcaaaggtactggtgttgtgtgggcacatatttgggcaggaatgtagatcctcttatcctactactatatgggcatctgatacatagatgcacccagccagagagtgctaaccctgtgccctactgcaggaggggtctcagcaagcatctgttcttgtcgcaggtaaggactctgagacctggaaagggttacatcatttacgtagtttaacacagacagtaaaatttaattggggatcaaaaaaaaagttctaaatgtttactttatggagtattgttccttaaaaaatttggatttttatgctttcttacaacattaaagtacattcaccactttttcttgttttctcagaatctgcgacatggataaaattctatctctgcatcttacaggtattaaaatccagttccctgcgtgcatgctccagtttaagtggatggctgattctatcccgtcatcctgaactttgtagcttcctttaagagatgataaattagggaacaaaaggatcttcctttccgtgacagcagcactttcgggaggctgagcatgtacctctgactcaaggctgagttattataagaaaaacagaaaaggaaggaagaaggttttaatttcccactgttgaagacagtttgtcaggatgagagacagacagacagagcgtgcacagacctgcacttctcttcggggatgaatagggcaagtgtttcattcatgacgtcttcaaagcgttgcccggaatgcaaaatgacatggtttttctggaatactagtctgtttgaaaggccaaggaaaggtgatacattttgaatgcacatttgggtgacttcagggtctccttctataaccagaatggagatgtccctgaaaggctgtcaacagagaaaaaaagaattctggttaaaattccattattccagttttttttttgttgttgttgttttttttttttgcctgcgttgtgtaattgaagatgtcttccaagcagaaacagacccttgtttcatgtggaaaaaaaaatacatagactaatagactacagagaaatagaggtaaaaagaagattgctgccacttcccagttaaggaatgcgttgctttcacccaccgtggtccctgctgcctgtgactccaacacaagaatcaatccatctgtctttctgccaccacagacatctccctaaattgatctaatcttgtgtctattcttaaaattcttcggattgcttcttgttaatagataattgaagttcagtagtacagtctttccatctccctttccttcctgattgtcaaatcactttgacccaataaatctcacttaattttttaattgtatgggaatttaaaaatggcacatgttttatcatatgcctgggctgctctacccaacttttcaaagttctttccatccttcaaagtctagctcagcacctacatcttcaaacggtaaaacttctctaatttttttgcatgaaataaatgtgcctatccaatcaggatgagccactcagatgtgtgactgatgtcacacagggcttcaagctcagaagagcccaccggatgaatggtttatttctctgctgttgtcatcttgaaatttgaagaaggggcccagcattttcattttgcactggactcacaaacgatatagccagtcctgcctccagtactcctaaagttaacaatttcatatctctgctccaataattctcatccacattgttgttttgaagttacctttgtaactcccactagattgggagctctaggaagccacagatcttatttgttgagtttctacaagtgtggggaagagtagtgtgcacagattaaagctgccaatgggaaggtaagaatactatcagagttcatcagaacagaactgaaaacagccaacatctcctgagaatagcagtgctatgttctgagtgtttgtgtccccccaaaattcatgtgctgaaatctaattcccaacatgttggtattaagaggtggggaatttgagaggtgagtaggtcatgagggtggagccctcatgggtaggattagtgttcttatgaaagaggcctgacagagcatatgcccttttaccacatagaaggtgccatctatgaagaactagctctcagtagacaccaaatcttctggcaccttgatcttggacttcccagcctccagaactgtgagcaataagtttctgttgtatataaattacccagtcaaaggtattttgttacagccgccagaatgcattaagacaaatagtaaaaagaacaaagaagttttgcacacgtagtatgcaccaagcactgtgctttgcactgcgcgagaaaatccaacctggttctcacaacatgaagcataggtactatattatggcttcagtttccagaggaagaaactaaggcttagagagggaaggtgtcacacactaagcagcagtagcaggagtcgctgtcagttctggctcctaggaaatcaatgagtctgtattcataaatcatagaaaattgtgacattttcatgcaataaaaaacctaagaatgttctttatatatatacatatatttttattatacttcgagttctagggtacatgtgcgcaacgtgcaggtttgttacatatgtgtacataacattaggtatatctcctaatgctatcccttccccctccccccaccccacaacaggccccagagtgtgatgttccccttcctgtgtccaagtgttctcattgttcaattcccaccaagagtgagaatatgcagtgtttgtttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgagtagtgccgcaataaacatacgtgtgtatgtgtatttgtaacagcatgatttatattcctttggtacacaaagtaacaggatggctgggtcaaatggtatttctagttctagatccctgaggaatcgccacactgtcttccacaatggttgaactagtttacagtcccaccaacagtgtaaaagcgttcctatttctccacatcctctccagcacctgtggtttcctgactttttaatgatcgccattctaactggtgtgagatgatatctcattgtggttttgatttgcatttctctgatggccagtgatgttgaacattttttcatgtgtcttttggctgcataaatgtcttcttttgagaagtgtctgttcatatccttcgcccacttgttgatggggttgtttttttcttgtaaatttgtttgagttctttgtagattctggatattagccctttgtcagatgatggaagaacattccatactcatggacaggaaaaaacctaagaatgttgtcactgtaaccaagcccaagggagcaaaattcttttctcttgcagtcccaaccctgagtttacaaaatctgtccacacatacccagacttttgagttgtcaaataagtttctaataagaaaactttttttagtttatgccaacattttactaagcccacctgcagctccctaagccactcctttaacaaaaatactatctttttactttctagttttttaagcaaaaaattttatatatttggagaaaagtgtttcatagacaagccagaaaatctagggagaaagagatattacagaatctgctgagcaagaggattgggtggaagtcaaacccatgttagcactccatatgggagctccaatatagtcatgaagaaggcccccatttcccattagcttctgagcacttgtaaggcatcaaattcaaggagacgactaccagggattaacatcaaaggacattttactgagttgagttcatcagcagtttctacttattaatttattgttaaaattatatgcttcatttccgttgcaggccttctttttttactgcttaacccaaatatgtaccatgggcaagatacatacagtgctttaaatatgttactataagaatttgcattccaaatcaagacatcattctaaatcattcccatcaagatattgccaaaagcatcacacataggctatagccctcaatatatattattgtctttcatacagagagactgttcaataaaaaacctcattgtgtctgtccttcatgtttttaagctaattaagtgttccaaagcttaggtcttttatgattgtgaataaggattgttattcacctcagtagttttcaggaaaagataatgcttctgttctctctttctcagggaccactattacctgagtttcctggagctttgagtttttttcaaaattgttttcttaaatctttaaatgaattgcatttctctctcctctaatgagcaaaatatgaagaaatgaatgactggatattctatttggacacaaaaaaggactgatatagcatctgttcacttcagcaaggttgctccagcctacctacatgtatacctattttccacccatgagaatcgaagttcccttcagatataaatttccttctttccttctttctttctttctttttgtttctttctttctttctttctttctttctttctttctaccctccctccctccctctttccttccttccttccttccttccttccttccttccttccttccttccttccttccttccttccttctttgcagaattttgctgtcagccaggctggagtgcagtggcacgatcttggctcactgcaacctctgcctcccaggtttaagcaattctcatggctcatcctcctgagtagctgggattacagatgcgcgccaccatgcctggctgattttttgtgttttagtagagatggggtttcaccatgttggtcaagctggtctcgaactcctgagctcaggcaatctgcctgccttggcctcccaaagtgctgggattacaggcgttgagccaccgcaccttgtccagttagggatttctaagtaatgctaatgacaagctgctccagggtctgatgttcccatgtggtccctgttggatacatttttaatcctaattttggaaacttaacaccaggtatataatgactgagaacggctgcaacttatcaagacacaattcttacatcacatatatgtgatgcagtaggagaatgtataagaaatgtcaaatctcattctttccaaaatcttgtgttaggtaatttatggtttttatgactaaccaattattctggacataaagacttttaaaattataataatgaaatttacttggacttctagttgaggtaattacaggtcatgaggaacacagtaaaagctgccatattaaagaacagttataattgctgtaaatgattttgttagtgcggaaccagttgtaatccaattacatccacatttgaaaatgacaagaaaatgttgagagacatgtttcccaaccagaccattcacctgtcaccttgccagtgtatcatttgaaggaaatcttttgtagcaaataagaatatacccggcctcctttagatccagaattgaaaaaaattagaactaaacaacaacaaaaccatcagttattttgtaagaactgtataagaaaagagagaggagaattctcattttagtcaacgttcacctagtactgttctaggtgtcgtaggtattaaccagtttaaccttcacagaactaaatggcagggattcttatttctttttgcagttagagaaactgaggctgaaattaagttacttgcccaagataaggcagcaaatctggtttacctaattccaaagcttaagtttaacttattaccataccatggtaagaatcattttgatcttaaaattacttcagatgtcttagtatgttgatgtttaccctcataagtaaatgagaagtaggagattctatatgtgttcatacctaaatgacaaataatgaaaggtatttgtttacatatacattatttaatgaaaaaatgttgcattaataatttggacataatatggaatatttatgtaaatgagaagtaggagattctatatgtgttcatacctaaatgacaaataatgaaaagtatttatttgcatatacattatttaatgaaaaaaatgttgcattaataatttggacataatgtggaatatttcctcacaaaaattcagacaacaatttttcttccacttttatactctttatctatagctatatttaaatcaaagttatcagcagatcatactgggaatcagtttgtgccacaaggcaaaataaattgacagtattagaagaaaggttaatagtccctttgctaatcccaacttttgcactaggtttattattacccttgaaatagaacctacacgatcaatttcaaatatcaaagcataacacacactctacagggaacccataaaagaaagcagaggaggcaatagctttacagttaggaaaaaccacgattttgattgtgcgtggaaaacatcaaattaaacttggtacttgctattgactcagcatcctgcttctcccagcattccagcggaagtctagtctgctagctccccagagtgagacctttactcctgtggcattacttgctggcaatacagaattgaacaggttctggccttgggggaagcttatgattattttcttcaatgtgcaaagtaatgcttaaaggaaatagtctcttaagcagcccaaaatgtgaaaaaaacaagataaatgaggtttgcaaaatttcttcttttcctactaatttatttctggttcagtgaaaaattcattttagaagggttttattcctcctatgtcccaagcttggtcttcagtccccagttacagagttgttcacatcgtcttcttcatgccttttatttctgcacaaatccatgttagtcatgcccaatccccacaggccacctgagtgctctacagcacgttgctcccgctgcacccaggctaagggcatgagagatttctctctgcatgtagaaagactggaggcatgacagcaactaacgttgactaattaatgctgaaagggttaaagttgtcaagttcccaacttatttaccattgacacaccccagatttgttctgggatgccaggagatagtatcattgcacaggtgtgaagaaatagggcattctgaccacaaggataggccagaaatttgggggtcattatttcatcatgtacttagtgccaggaatttatattttaggtggataaggttgtcattgttccacaacatctgaggacagcagacttgttgaatgaatgaatgaatgaatgagaaagctctatcagctccatagacaaatgccgacttctacagattacttggagataatcttttaataaaatgaaaaaagctcaacaaacctgagcaactaagaggagctaacatttcctaactgcctacggcaccatgccaggtacttcacgtacactatttgtttaagtacagacaacctcctacttagtatctacgatagacagactcaaaggtggctcccagggatctccttcccctggtatttgtgccttgatatagtcgcctctcacagtgaatagggctgacctctctcacctgtaggattttgtagaaatgatggcacgtggcctccaatgccaggtcataaaagccgtcatggcttttgccttgctttcccttggataactctcagagcgaggccaggtgccatgtcactagggcccgcaagcagttccgtgaagaagaccgcatgttgaggaatcaaggcttcctgtccaccacccgcactaacgtgccaagcagtgagggagccacccggaagcaaatcctccatccccaggcaagccttcatgtgacttcagcttaccgctttcctcaaggcaatgtcaaagagagaacctgacaagtagatcctggaaccatccagctaagccactcccagattccagacccatagaaacaatgtgaaataataagtttttttttttttttaatcattgaagcctctgtattttggaggcatttgttacatggcagtagattgctataaaaaccattattactctcattttatggatgaagaaataaaggccatgagacccacaggtacaaaatgctaatagctttccctcattgatcaccttctaaagaagacttggaccaccgaggatggctgaagccaagaagaagagcagccagtagtgggtaaagaggcagaggcgcctactcatttcttcaacaaataactcttgggcatctgtggtgtgccagtcagtgttttaggacatgaatttgcatcagtggccaccatagataagttacctgtgtttttaaggcttacaggctagtgtgatgattgataatgaacaaacacatgaaaagatctattacgaagtacaatagaaggcaagggagaaacaggttcagggaagagcgagactgcgaaagggcagcctgccacctcttccttcccacacagagcatctgcagggcacaccccttcatccaaggctgcctgaatgtgttgctctgtcctgaaacatgaaacttattagacaggggccattcttctcttttgtacactcacatacatcccaggtgcctaaagctaagcctggtacataatttgtgtttagtacatatttatggcagtgtcttaaattctcagatggataaaatttttagtggatttacctgcctaaggagtttgacatttttcagctgttttaaggttagcacgttatttaagacagagtaaattctgctggtgtaactccttttgtattaccaaaagaacaaaactcattgtgtaataaatatgattttcttcccaatagccatgctagaaattcatttatgtaagcaagatattaagccccaaaaccaatgtactaaaaatgcaataagtgctccagaatactctaagaatcaaaatctgagatattgttatgagatccccaaagaaatgtccatgatccaaagaagaaatcagtctcgtcacttacacataaataaacccaggtttcttgagtctgtttagttccgccatgcagctgtgcggctccaagagcaccacaccaggaggaccagaggcttctcacttcacgatcacagccactgcagcctctttgggggaacgtgagagtctcttttaaagccctgtagtctcaaaaaataaattgtaagtttatgaaaggcagaaattaggtagttattacttgctgatcaaagtggtttattacattttaaaatgttagtactaaagggaacttcaaatattagggggctcaatccttctgctcccaaagagaagcccaaagaggtgaaatgatcatcctgggaggcaagagcaggaggagttgctcatgccagcctttttaaaaactcctcccctggaaaccatcattcttagcaaactatcgcaaggacaaaaaaccaaacactgcatgttctcactcataggtgggaattgaacaatgagaacacatggacacaggaaggggaacatcacataccagggcctgttgtggggtggggggaggggggagggatagcattaggagatacacctaatgctaaatgatgagttaacgggtgcagcacaccagcatggcacatgtatacatatgtaaaaaacctgcatgttgggcacatgtaccctagaacttaaaataaaaaaaaaaaactcctccccaaacacattgtgtttctttgaataatccagatactgtcacctattatgactcaagaaagtttggctgattatttccaatgggactgtaattaagatgccattggaggcagtgttgcatagcaattttagaatctgggttctgaaatctgagatcaggcctcaaatactatctccatcattttttagctgggcaaattaatctaattctgttttttcacctttaatctagagataaacacagcacatatctcgtggagttttgtgaggatcggacaagatgtcatgggtcggttttaggaatacttcttagtgcgtgtagaactgctcatgtatcctaaactactgctattgttgtaatcattatttcattatcttcagaatgtcttgaagtctgagagttaagatccagtgagagttaagatcatggtggaccaaaaagactaaaaagagtttaggctatttcttggtgcctggggcttatgatggtagaaggaagcagagacagtgaaggagagagggctgctgaagggccctggcctctttcccaagccactgcagattatctacatgacaaccgtgtgcttgtcactgcagcttcaaagcaggtccctaagccccttttcctatcaacttgtcatttccaagcttctcaaaagtagaaattctaactggtcttcagtgggaaggtcagggtaagtgatggaatatttagctggtgatattttatagttcaaaccaggcattcacaatagggaattgtattcatggggagtagaaccctcattctggagctgcttagttttagaatcaaatgaatctcatgcccaggaagaagaggggacaagacgtcaatcataagaggccatcagatcccactatgcagaggctgatgggacatgagagtctcagaatgcaaaccaaccatgaatgaggatgcgtggtgtgtacacatgtggcagagaggagagttcctggactttgaaatgagggtatagccataaccttcttatcagaattgaaatgtggatgtagccataactttcttatcggaattgaaatgtgagtgtagccataaccttcttatcagtgttgaaatgcgggtctagccataaccttcttatcaaaatcaggcatcacagggattagaagggcttcagcccaggaaacaacatggaagtggattctgtggcagcaactgaaagctaaatccctggaaatcaggatgaaaaagcgttctctccctcagccacgatggaccagagacctgattaggtgtgtagatgtgtgtctgtaagtgggtttgtgtgtacacactatgatggtctacgtttgctttttggaagagggtttgctggtcagcccctcatgtggagtaaggcagaaactggggcagtgagcagcagagttgtgtatataacacctgactggttttattagagctcaatatccctttatatctattataaaaagtgatgttcatttgcataccataggtgatgcaggtgctcaaatacagcaacaatcgctgatctttaaatacgttccatctgtgggtaaaaataattaccttctgaatctctgttttacagttgcattcaagtggggtgtatctgtgcatgtttgtggttggcagaacaatggcctcccaaaagtatccgtgtcctaatccccacaacctgggaattaaagtagcagatgaaattaaatttgctaaccgacttactttaaacatgcagattatcctggattatctaggtgggcaaaccgtagtggcaaatcttttaaatgaggaagaagaaggcgtcagaagaggaagagatagacagaagagtcagcatcagaagaagacggtgtgagaaggactgacagctgttgctggctttgaagatggaaggagtgggtgagccaaggaggaagagctgccctagaggctggaaaggcaaggagatgggctgtgccctaaagccccaggaaagaaggaaagcctgctggctccttgattttcaccctgtatgacctgtttcagagttctgatgctgtattctttaaaccactaatttcatgctaattttttatagcagcaatagaaaaccaatatcatggtatatgcatttttaaattttataacacaaatagtttcaaaaagtgagaaattcagatgtttgagctcattttctgagaagttccatctggaagtcagatcacaggagcagtccttctgactctgttccacatcgtaataaataatacttatgttatctcccgtatactctgacgccttgcaaagctacacaccatgccatagatttcctaaacagcaacatttagagcaatcgtttccatgtaagtggtactttctacaaccatttgtttcttttttcttcctttaatgcattttaattaaaggtaagaagagaataaaagagagttggaggaagtacagcagctgtgatgtgtgggtataggagagcacagtctgcagacttatgctccatttgaaggtagaaaaacagtgattatagatatattgctaaatgagattctacataaatccagactttgaacatgagacttgatgtaagtaaaaaaagacactgattcctcatggctgcatgctgggttttcttgatgtttaattaattctaatgatgaagtctgagtcataagtgctcattcaacagagaaacggaccctattttaaaaatataagcctttacacaaataattgttggctaaatgcttgcagttatcaatagcggttccgattttgaatgtaatgtttagtgcacagaattcctcgccctggccaagcagaaagaaaaagtgcaaaatcaaacagtcaacgcgagaatttaaaactatacaaaagagagtcaatttttttatgaggaggtgatcacatctgtggtttttctgggaaaaaaaataatactggcttccttcgtggactctctcctgtatttagatcgactggaatgtgctctaagaaagcacactcattttgacatcagcataagcaaaacaaatctgcctcaaaacatttgattgtaaaacacctccagctcacccactgctctagggatgtgtcggcttcttcaggaatcgtgggtgatcataacacctggtaggcacatcactagtgaagtgtggaaggcaatagcaaagctagaatcaacaatatctcgtttcctacatcatttaggctcaaggaaaagactttgtgggaattgtggtaactgctgttgtgtattattgttatgcattattaatagaaataattttcttgccatatcactcgtaggtagccttgtattttaaaatataagaagatccacggctccctatctacctaatatacaagtctatgattgtatggtgttcctttattctttctactataaattctacttacagttttcaatatctttatggaaattaatatcttaccgaatagagtcgagggagtttcaaaaaatgtatacaatcaatttgtacacatatgaaggtgaagcaaacatacccatgtcagtaaaattactgaatggccaaaaggggaaataacccatgaatttcatattaagagtgaaactgtttagagtgaaagaaactggaattttcatcttgctccactcctaactagtcatatgctccaggactacttactcgtcatgtttaaaccttattttttttgaatattttctttttctaaaggttaaaatccccactgagcttgtgggtttgttgcgagtactgcataagttaacctaagttagatacagtaactgcctaccccaaaccatcttgcccctcgtcctctcctttcctgccagaactctgatttactccaagtgctttgatcttaggctaagtgagaccagcacctgttccgcaggtatgttctataggtgggcgtggcctttgttgggcaatgagatataggggaaagtcttctaggggctgctggaaagttttgtctccctacaaagagggaaggagcaagaaaacacttcttccatgccattgcgtgcttcgtgcctctgaactctgtccactgagaagatgatgcttgggattgcctcgccagtcttgggatggggaaggcaatgcctggagaaataccagcaactgcttatttccagaattactgttttgtggtgggaaaatccctctggttttaagactgttgactgctggtaagactttctagtatttgaaccttgaccttgttaggaatgcagggattgttaatgactgtttttaatgttgttttactatattatagtgtatcacaagtggcactgataggccggtttgataagttcccagatgagagagagaattccaattgcaaaagtcatggtaaacttcatagaggagggatccatcccactggacttgatgggtttcagtctttgagcatggagaggctggaaagggtgtgtgggggagttccgttctgagctagtagacccttccacaggtatgaataatatttcaagactcagtgtaatgaggacaaaggagaagtgtggaaatggagagcttttcactcaaatctgcaggcccaccttctcttgcaaagctcttctagtctatgtattatctttgggttatctatggacttagagtaagtgcaatatagatttagtttggctttgttttgaacactatcttgactgactctaatagttttagaataaatatagctttacttctacttacattatttttgggatttttttttaaagaaaaaatacattcgtttagtttaagaattggtaaaacatatatattgaccaggttttatttttcatccagcaaagtatcacgatttgttgcaatgtgcacagccagcttaaaaaaaaaaaaagagctgttcttagggcttatactacctaatttcagcagcaccactaagagaaacaaggtgtagctctaacagaaggtgaatggggaaaacaggcacagagaagaagtgggtacaggcagccgcctggcctctccttattgcacaggacaggcagggcagggccgctctctgtggccaggcttcagcaactcaggcaccccagtgccagaatcagccccaccacacaacacgtacaggttagctggaaactgtttaggacacacagagtttctccaagtagcaagaaacatatcaaaggaccatcagacccaggaatagagtgaaaatgagtgacagcacatttgttcttgattcccttatatttcctggttgggccagaacaaaataagaaacagaaaaggtgagacttgctgaatgtcacatggcatttcatcattatgttatctattttggaacatttcaactcattttcaaccttttccaaaatgtttactttttcaggtttttccagtcagtgtttctagtattgtccccaccattttttgtagcagtctatttttgaaacgcacatctttggctaccttgaataattggaaataaaaacaatgttgaaaagaagtcacagagtacctaagaatagacaaggactgtggcagttattaaatattattacattaggaagtatcatgattttgttaggtaggtgttttgagacaataatattaggtctaattgttttgcaagtgggtaatttgctcagttacatgtgattaagaggggaagttagggtgtagcttagctgtgcctttttccaagatgctgccctgttctcagtgtcttgcaattctactgcagctcaatacccatcacattcagtggggtatagagagaagaaacacagaaaaagcaaaacagacaaaagaacaaaggaatttagttcaatttcaatcaaatatctgattttgatttttaatcaaaggggatcaaaagtggtcaatacagaggggccatttgagtcttgtcaaaataattataatttttgtttttcttaggactgcattttaaacacttagtgaagaagtttggtagtatgctggcatgaaaacagaaaatgtgcccttgttaacctatccatctttaaacaaaacaacaacgacagaatgcagcaattattggttgcgtgtcctattaacccagttcgttgtgacatgtgaggatagactgagaacttgccttgacttgagtatgttatgtccatacattgtaaagtataatttttcacagcattttgcaataagtgaaataggtattaatttaagaatagaaaatatatatttgggaccaattctcactttgcaatactgacaattatggtagaagataattaatgactatagaagaataatcaatgtttagtttaaaagggttttcaaacaaagactattttaggctttaaaattactgttgtttaaatttttaaaattaaatatatatgatatttaaaacagtatgaatttccttttagtttttggattgcattatttttgaatggtctcattaaccaaaaatcttaaatgattttaaatatttaccacaatttcaagagcattcagtaaaatggaaattgtctgtttttaattgtatagctttcgggatgcagtgtacacctaaattgtattcaatcatgatttactacataaatttgattaacttaaatgcatggtaagctctttcctgttaatataaatggaacaaattagtgttctaaatagaataggaaagacaggaagcaacgcaaatattccagattatctgggctgtttttaaatgctttttttcttctctttacttagttaaatctcccttctataattaaattaaaatgattgtgcctggatgattaaatttttcccaatatgtatgtttcattggtaatatctaaatgttacagtataatacatattgtccaagtggggtacgaaagtctattaaaagaaataattttgtacatttaatctctctcctgcaccctatcaaatttagttgtaacaatatgaaaatgtaatttgagcttattctcatttttttacactatgcttttctcagtcctggaggatgaaattatattatctttgttttctgtattttgtactctctgaactttttaaacatcaaaatgtacatattatttataatcagaaaaaaagaaagctgtcttattttgaaaaccatcattttattgttaaaagcttatcagaacgagggagaagccttgccctgtttactgttgtagacacactgttcattaaggatgacttgtttggaaaaatccactcccaagacctcttgacctctagggctaagcatggcatagcactgggtgggttggggataagatcataagactgtggcgtgggagtgcttgagttcggatcccagctctgtggcttattactctttgaccttgggcaaattactttgtgccttttctctttagtttattctcccataagtgttgataaaaaagtactagctatctcacaaagacttaagacgttaataaacacaaagactttggaacaatgcctagcagaggtgaccattctataacttgatgttaggtgtgactatgagctacgtaatatgaaacacttccaaaaaattaagttaaaaaagaatgatatgcaaatattcaaaaataatctgaaacatccagtggcattttccccaggtccttgtctctgtgggactatactgctccagacaagagggcaattgagcatttgccccgtgaattgaggtaaaaaatgccagcagattcatgggcactggacacaacagataattcagagaaaaggaaatacagatagccaattagcaatgaaaagttttcaacctcagtgctaatcaagaacttgcaaattcagataagggtaacatgtggttcatttatcaaattagcaaagattataaaataaaggctaaaatccaagacatgaagggtcagacacacattcttatacactgctgattggagtagaaattagtcaaaccctctgaaagcaatttagcaatgtccagagaaaacatacaaatcctcaagagctttgagttagtaactttttccggggagttatcctaaggaaataaagataaagacattcatggcagcagtatttataacattcacaaatgaaaataatctaactttctaacaataggcaattagttcaataaatgagagtacaactagatgctagatattgtataatattgcagtaatattggtaagtagagatattaatgagttttgaccttaagtcaaaactacttatgactgaaggttggaccatgtaaccagcactgtttcctctgggtgtaggggagtgcataggtgtgatccctggctatactctgccctgtcaccatgctttcctggtatgatgggtaaatttgggatggataactgaacatgatctactctaccctttttcctttggaaatctagctgcttgtagggagcatctgtcctcttctcctgggtgatagaatctttctccagaggcatgttttttcctcccatatcggaaagattgttccaactagcattgaccaagagaggggctaatgctgcctacttctgagattcaactgggaggattatttggctatcacactaagccacatacttcagcatggcctttatcaataaaagtgatacattgattttccatctcccagcattcttttatttgtatttttcaaacacttggtgggaaagaaaagcattatactttaaaagactccacaggtacttcaacattagaaactgaccattaataaaaactacataacaacttagtcccaaatgtcagttatttgacatcaatacacttttattatctcatagtttgtgagggtcaggaatccaggcatggcttagctgaatgcaactacctcaagttctctcataggttgcgatcaagtttcggctagagctgtggtctcatctgaaggcttgatagagggagaacttgtttccaacctcgctcatgttgttgtggcagaattgagtttcttgctggctattggcctccagcctttctcagccccttgctgtgtggattgtctcctagtgcagctcacaacatggcaactggctttcctcagagcgagtgactgagagtgcaagggagcatgcacaaggcagaaggcactgtggttttgtaaccacatctcagaagtgacattcctattacttttgctatattctatttcctagcagagagtcactaggtccagcacacactcaaagggaggagattatataagaacatgaataccaggaggctaggatcactgggcaccattttaatggctacacacccccaaaactaacatccaccacaagacaggctcatagctaatctcatttaatcttaataacaagccaaggagtcagttaataggattatctgattttaaaaatgaagatgtggaggctcgaaaatgttaagtgtctggtttgaaagctcacaaaatagtaaagggactgatcagggattggaaccatgacagtccactcgcagattgtgtctccttagctacttggaaaatattaaggaaaaactggaattgcagataggcaaatacattttatgaccttatttttgttaaaaatatatttaaaagaggaagaggacatattaaaatattttagaaaaattttaaacctttcagtgaaggaattacgagtgggtatattttcccctattctttacatgttcatatatatttttcaaaatgctgattatgggttttttatttatctaatatggggcaagctatgaacacaacagaaaaagtctgttctcataggccttacaacaccaggccaccaatggtgtgtgagccatctttcctgagtgcaagcagtcaggtgcactgtctccaaaaggtaacatataaatagagacctaaataaattgagaaaacatgtactgttttcataatcacaaaaatatagagaaaatttaaagcttgggtgtcccactgtagcttaaaatttgaaagttttaaaaattttcccattcattcattttatattcagtcctttattcactcagttatgcatttttattgagtgcctattaggtgccaagcactgtgctaagtactgggaatttagcagctagttaaacatatctcctttctcacattcattttagaatagagtggagaatacagttgttcatcaacaaatgactgagatatataattgcaaactgtgatatgtattatgaagaaaatacacaggctatcaagacagcagaaaccagcagtgcaggtcagtgaagagtcagccacagaggtcattggaattgtagtcaccagtagcatccatttgggaaaggttatatgtaaaaagagaattgggtaagaaaagaaccttgaaaaattcccaaagctaatggtgaaagaaagaggatgagctgcaaggaaaattgagaggtaggaggaaagtccagtggaagccaagggaagaaagctctcctggaggaggagagtgggcagccctgctgcatgaagaaggagagggctgagaagtgagaaacaccttcggtgtttagtgacacggtgtgagtaagcctaggagcagccttggcagattaaagtgggttgtaacttgatgggaggagaagaaacagggaccatgtatattaatagcttttaaagcatatttggctataaagaagaaacatataggtttgtaggtgaagggaaaagtggaaccaaagaagggttttagattatcttttcttttgaaatatgggagagactgtagttactgaaatagtgaagattttgatctcatagagaggatagatgttggctgagggtggggaccattagaaaaaaggtgactggttcctgagaagttgagtttgggggaagaatccagagaagaatagaagaaaatgaatctccttcaccatcctgttgaatgtcctactcttgtcatctttctctttctttcaaggaagcaaaggaatctttaaaatgttttcaaatgtagatgcttagaatttgggagcataaatgcaaacatcacacctaaggatattttcattactcatctcactttttaaagcacttttctatgatttcattatttttatttccaggacagcctggtgaggttgttgggatggctgccaatcaattcatgtgacttatctatggaaacacaatgtcaatcttgctatttataaagtgtcaagagatctatatcacctaactgtcatgccaatgcaattttatttttttaccatactatgcctccttagactcttaaatccattaaatataatcataaagttcacagcttgagagtataacttgaagacaaagaagaaaacaccacagagaaggtttggctcgtttatatcttgacaccctggtaaatgctttcttcactctcatctgaaggaaattagatggaaataggacacatgtgtaatgtcttccacatgaattgaagtgcattgtggataaatgtctggacttgcacgcttgacaaaggtcggtcttagtaccatttactcagccgctcctgggtgaacagacactcctggagagccgattccctcaggctctggagacactccgagcccccgtgcttcttgtttaataacacgagcagcacagagttctcaggcagcctttgtggtttgatgaaatggtatatattttcattagattttcgtgtgtgtatgtgggaatattctgaaaacagcaaagctatataaagataagtaattacattaataaaataaaataacaatactaacacttattgagtacttactctttcctattttcaatagctttaagtggtctctcatcctagtatttaattcttattccattttaaatcctgtcttagtctgtttgtgttgctacgaaggtatacctgaggctgggaaatttataaagaaaagagatttggctcacggttctgcaagctgtacaagaagcatgacaccagcacctgcctctggtgaggccacagggaactttcattcatgatggaaggcgaagggcagctggcgtaacccttagagatcacatggtgagagagggagcaagagagagggcaggaggtgtcaggctgtttttaacactcagatctcaggagaactaacagagtgagagctcattccttacctggaggacagcaccaagacattcatgagggatctgtccccatgacccaaacacctctcaccaggccccacttccaacgctgggggggtcacatttcaacacgagatttaaaggagagaaacatccgaactatatcgagttcttaatcaaggacatagcattaatcctgttctcaaaccaataccattgctggcccactgacatagactaggattcccttggaagcacaagtaatggagaccacagctaacattttggagacaggctgaagcttttcccaacatggagcgagacgcctggaaaataacccatcttgttcccagcttgtccttttacactaaggcatgttcagaagcatgaccagtccttctccctctcctctagccatgctgaactgtgctgtcttttaaatcctggcatttatttctgaatccttggagctttctgctgcaaggtctgttcttcttccctgctctcatcccatcttgacctccatcagtgtggtcaatttcaacagaccctcaggtctttctccagaaagtctccactgaccactcccctacacaaccctactatgggtggagtaattgccaaacaccaatattctaaaacaatcacgtacaaaatgttcttgaaatacattgaaataaatggatatgtaattcttttcagttactttcaattgggtaaagaacagagcagcagaaataatgagatccagtgtttttccttcttttaatgcaggttgtagggctgggattttacttctgaatgctactggtttgtttaattttccaaaaaaaagtgtgagaatatatgctcaaatttctcaaaatacttaaaaacgtattttatttgacctcaagttgtacaaaggagttcagccaaggctcgtgcatttgatgacaggtctctgaagtagaaatgtttgaattctgtcttgaaacaattttgcttctaatcatcttgcaatgattttcaagttattcttgaatttttctgctccattctatgacttgcatggaatttattttgtgacggaaggccacattctgcctatgagggctggttattctgttagaatttcctcctgaaggttcatgtaatattattttctttctctcatgattccttcttctttaattgtcttataagagaacacttggtagttcaaatcacatctaatgtttccctgatgccaaaagcattagtggttttgttaattccaccaaacaaactctagtgtctgagtgtacttattacaattcatctaattcaagtgactggccatgttaatcaacacagcagctttttttatcagtacatccagaggaataaatgaaatacaagacttggaatctgggttgtgtgttctgtttctcacacctacaattaattactttcagatataagtgatgggatagagggagaaagctgagataagggacagttcaatgatagtggaaagcgtatgtgaggtgcagtttcagggctgcttcagttcagcagctcattcttgtgcataaaggagcaggttctttttatcactcttctctgccttccatgggttagattgggcctaacactggctgcctacctgacagcaaaaaattgcaattccagactttggtctgtacatgcacagaccagcagaagacaaaatatttttatgtgtgtggaggggtaagctctaaaagggtgagagtttattttccagaaatcatagcaaaacttctcttgtgtctcattggccctgaaatatgtgctcatttctagaacaaagtctgaccagggcatagtcaaaactgcttgagtaaggcctggataactggattaacgttaagaacaagaggatggcattacccagattgctttgaccagtcagctttcaccccagaagtggggttcacccctgttctgtgataatcacctgtgctgtgtatctatcgacttaactagaatgtggattcacagaaacagggtcttgcactcatttcactttgcatttctaggtcagaacacatttgctctcacatcagaagaactcaaaatatttattcaatgtgaataaagtagccagtttcccatatgagctgctattaggtttgttccctttcagtgattccaagattactcatttagcacctatttgataccggacgcaggggaataaaatggtgatgaacaacccagtccttgatcttaaggaacttacagttttgtaagagagagaaagatacatacataaacaattttaataaaatgtgatgatgttactgctgagcgctgcagggctgagttggggaacttcctgggctaattggaggtgaggaggcctctcagaggaagcgatatctccatggaggtctgtcaggcttatgcagctttgccaagagaagggggagatgaatggttcactgtggagaaggatgattcactttagagaggaacatgacaagaccccgttatgatacccatcattcactttacaaagtctcactgcagacagtgtgatattacctattgttagactggcatggtcggttgctctaaccaggagcatcaggggtattcagccagtacataatgaggaagctaattctgcagaagcagcttctgcaagtgtttcagcttttttgcttactcgacaccagagaggcccactacttagcataatttgtctcagaaatgtgtgtttggccgggtgcggtggttcatgcctgtaatcccagcaccttgggaggctgaggcgggcggatcactaggtcaagagattgagaccatcctggccaacatggtgaaaccccgtctctaccaaaaatacaaaaattagctgggcgtggtggcaggcgcctgtagtcccagctactcgggaggctgaggcaggagaattgcttgaacctggcaggcagaggttgcagcgaatggagatcacatcactgcactccagcctggcaacagagcgagactccgtctcaaaaaaaaaagaaatgttgtgttcatccatgtcttagccccttccaactgacataacacaccaccacaaactgggtggcttataaacaacggctgtttgtttctcacagttctggaagctgagaagtttgagatcaagatgctggcaggttcagtgtttgatgagggtccccttcctggttcagagacatcaccacctcctgcgtcctcatgtggtatgaggggtcaggtggccctttggggcctctcttataaagatactgattccattcatgaggctttgccatgtttgctatatcaactcctccattaagtattattatattccctagttgtcagatgaggaaactgaggcaaagagaggttgaggcacttgtctaaggacacagaggtagaaagcaatagacagtaggtggcaattctgaatcaggctcctgagccaccgtaggagagtggggaaggccatttgtggagagatagccttcacaaaggccagcttgtcctaaggagaggagtgtggaattgttggagggatacagggagccaagggacattgtttaaaattagagatatttcggagtgttgataaggtaataacaataaactcgtctatatacaggctaaaaaagagattgacagttgaacagaagcccctcaggaggcagaagggggtaaaattgaggcaaaaaaggacaaccttgtaacaagaaggaagagtgaaaaataagaatggaggaatgggagaaactgccatgtgggaggaatggcagaatgctgatgtattgattttccttgtgaagtgtgaggagagtgaaggaggaggtagaatgagagctttgagtagagtgatgttttgaaaaacaagtgtcacagagaatggagagaacagtggataatgaaactaagaaagatctcctggtagtgacgagagcctgggtgggtttggagaacagaaaatgatggtggcaaggtagtaaatcacatttttttggggaaaaaaagtcaaatgctctgatttggagggtttgctaattttgttggttcaaacaccaattttgttgattcaaacatggttcataacaaaccactggtggtttaagaagtggctcaaaaaatttctgcatatttaaccactgactgtcaggaaaacacaatcttaggccagtgcatcactgacccataccggcttgtgagatttcctctacagcacagtgaagaaacagaagcagaatgcttaggttggcccaaggttgtggtttcacctggtgaattacaaaggaaaagggacagaaagataagaatataactaagggagtgatgtgattacatgtaatccagattgcacagacatagtggaggtgatgagaaactactattggtgacagtgaataatagatatttagcatcattcttatggggtggtttgtgttgaggggagaggttatggaaggaatggaagatcatgtgtaggtggtcaagatcaagtgaaaaataaaaccttacaagtcttttagggacctgttaaaagcaacagtaccggatggattatgaactggagtaacagatacctggatgcatccctggaatgcacaagatgacactttgtttactgtccctgagaccttacaggtggtcagctccttggctgctttggaagccaatacccatgaaccaggactcaaagggactgtataatttcaaaattccatagctttgtttgagaaagccccaaacctctagcagagaataggtgttccacagtctgaaccaacctggtttttgtggctaatttctcattctttttttttttttttttgtatccattccacatacctctttcacccacactcacaactgtcagacaagattattctgcactgtttagtacctctccgcttttacacatgttctctccttcttatttatacacagaatgccttttctcaccacccatcatctttggccacctggcaaatattgacttattctttatgctttctttctaaagttctcccttttataggaattccttcccctgccctctccaggatggcttgcccttcattgtgatagtgtagtgttctgtgcaataaaaatggaaatatttctcacattgcattctcactttaaatttatttatatctctctagcactagactgccaccttcttgaggataaggattatgtttgattcatactggtatccctattacttagcaaagcaccaggtatatacattcaaagcttttgttttgttttgttttgtttaatggatgaggtccatgttgcctggaacctacaatcaaaagatctaaatcattctgaaaaaatgacataaagacaatacacatatgtttccaatgttaccttctcattatgttagcaacaagcctaatatgagaatatggaaggaattttgagaacagggtataccaaaatggttaaaggcagggctaatatatgtagtgatctcccattctataactgatatggtttggctgtgtcctcacccaaatctcatcttgaattcccacatgttgtgggaggaacctggtgggaggtaatggcagatctttctcatgctgttctcatgatagtaaataagtatcacaagatctgatggttttaataatgagagtttccctgcacaagctctctctttgcctgccaccatccatgtaagatgtgacttgctcctccttgccttccgccatgattgtgaggcttctccagccacatggaacagtaagtccattaaacatctttttcttcccagtctcagatatgtttttatcagcagtgtgcaaatggactaatataataacacaaaggataaattgctaacccataatgacactttcccactgagccaggacgaaaccttaaaatccttttcagcaaagccttccaaactgtcacaacaaatagtgtggagctggcatgtgggaggaaccttgtgcaccatccacaacagaaagtctctctccctagcagctgactctcaaaagtggtaaagaacatttttcctctgcctttggttcactgaaactgttctaaataatatgctccatttcactaataagtaaaaagcagcagattgagtttgttcccaagccttaattataaatcattttatcttccactaaagagtatattttgatattttgaaaacattgaaaccattccatgtcttaatgaacaacatagaaaagagttctacatcttgcataaattcattttgcttaaatatttccatggtccactgtgtaacacagtttatctctagttcaagaaaattcttttataaaacaaacactgtgttttatgccctgttatcacatcatgattctttatgtctagctgatcaataattagatgaagatacttttttaaaaaatcaagaggtgaatttaaaaaaatgtgctggggaatcagttttctctttcagtcaaaatatttatgtatttctttagttcttggacattttctaatatctttttttttttttgagacagtgtcttggtatgttgcccagactggccttaactcctgggctcaagcagtcctcctgccccagcctcccaaataggtgggattacaggtgcacaccactgcacccagctatttcttttatcatttatttgataatttcatgtctttaaatttcttgtcatcttttatattttccaatctcattaactgtttatctttttgttttagatttcctcacggttgttcctaaatctttgcctggagtcatttatttcagatattgtatttcattatttgagagattctttgttctctaattttttctataatatcttgtttgtgtttcatggatttaccatattttaaaatttgtggaagcatagtaattgaactttttagtttttttttaatgattgtctcttctctaaattctctcttttctccagtgccaggtattcttccacattgatattttgaaattcgttttttatttgctgagtttctcttatatacatgcctaatgagtcgcatttcattcaagaagagaaacaactctgggtatgtctttgcaggaggtaattgaaccaagggaactggaaactacaaaaccatgggaagcgcggaggtgagtccgggcccagcaggtctctcttgcggagcaggggtggcgcagggagcatgcgcggcgcagggagcatgcgcagggccggctgcagccattctgccatccggcgcttgtgcaggtgccttccgcggagtcagtctaggaaacgtttccaggcgcctagtctttgcaatcaaaagaatcagaaatgttgctgaggccctaagaggcagttctgcacagctgctcaaaacagaatcggaggatggatgatgggggatagtgtgtgcggctctttgctggctaggtctcctaccagacttttaaaaagtagcacgtgaaggtgtatggaggtcagcacacagcgctgcttaggactctttcttcacaggaagtgggtaaggagctagctgtgagatgcaagtccctcaaatagtaacaacaacaacaacaacaaatatttttaatttggaatgccaccttccaagttaggagcatcagctttccccaacattcctttcagtttcttggaggagaacctctggggtttggcactggggaaatatcagctgttacttgctttccattttggataaggattgagggatggaagtgctgattcagtcactgtttctctcttcagcagcatgcctgcctcaacctcagccctcagccaatgccttctgactccgagccgagagcccttcctgacctcgtggctgagcgtctctggccttctctgcagctcctcaacggtgtggcagcgcagcgcaggccctcctggctgaccttcagaaatctgttgaaatcttaaaataagaaaacagggaagcttgctgcatcgattgactcttcctttcacgaaagatttctctgtagcgtgcaatgctatgcactggaaaaagaaagaaagaaagaaatctgttgaaatcactcgttcgttgctgttgaccctctccacaccgttgtctttgagaacctggattgtacttataggctttatttcatggaggcttatggcaaacaggtggcaagggcatatgtctactctgccatttaactcggagagttttgcctgctttttaaggtatctttgagtacttaatatgggcctctatctgatctttgcaccctgacttttcataacggtacagtgcacgtgaaaaattctgttcagtcaagcctgaactgccttctgaactcagatgctcatttttgattcagtttctttgcagccctaggaggaccattcttcttcctttcttcccctatgtatttgaataattcatcaaggccaaattaattccatttccttcatcaaggtgaattcagctaattgtagcattctcccttctctgaactataattgaaccattattacgtgataaagacatgtctatactagacaacctggtactacatatactttttgttatataattatgtatgtgttctaattagttaagtaacactctactagattctggaagttatttaaggcatgtcacatatgtacttatgcagttagatttaccttgctgaaaccaatgtctcttttagggcatagcatgatactggagatatggtaaaatattaatacacaaatgtacaatttattcattacaaaaaatttacactgcaatcaactacatacacacgttcttttttacaattttttaaattatactttaagttctaggatacatatgcagaacgtagggtttgttacataggtacacacgtgccatggtggtttgctgcacccatcaacctgtcatctacattaggtgtttctcctaatgctatccctcccctatccccccaccccctgacacgccctggtgtgtgatgttcccctccctgtgtccatgtgttctcacggttcaactcccacttgtgagcgagaacatgtggtgtttgacacatactttctttttacttatcttgattatttttcttttcctatcctgagttttccagacaaaatagctaaagaagtcaagaaaaccaaaggatattaaaacgaaagtggcaacagacaacaaaaggaattagtaattgacactcattgaatccttcttcttttccttattatttttatcagttgtgcttatctttacttgtgccacagtgagcactaggattcttccatggtaggttggtgtgtaatagttaaatgagcactcataatatttaggcatttcatagtgtgtcatcttaaattaatgtaattttcataaaatttacagtttgaatatattctatatgctattttaatttttttctgagaaagaactgtctgctgagaaatagtgaaatgaaactcttcattttgatgactgggaaaagagatgggagtagtgtctccactgccagacagactgcatctctgctgccagacgtcctgggatgttgctgtgggtttttgacaggcttcttgcactattgaagtcaaattctttcctagtagcacacacctttccaacactaatctatgtgaaaaataagaaaacctttcttcctgttgttggctggagcacccctgcatctttgaaactattatttcgtttgttaggcagaagctcctgggcagctgccagccttctctatggtgtttgagcactgacccctgagcacggtatgtgacatattattaaagaattattaaagaccaatggcatgctttggtcatttttcttatctaacagtcatagtaaaactgaaaactagaaattatgaatgacaagaaggggaaatttaaattagggccccaatttacttctttttactatcagttttgataatttatttttcattagcagaggtattttacatgaattttcttagtcttcccttcctttcttcagggtgcaggttcaaactttatctaacaattaatatacatttttaattatcatacgataatggtaaaacattaattaaaaatttatatgtattttaaagtgtaatgctaccatataaattatgtatattttatccatatatctatctgacacttacctatatcatgaatgaaaagaggttatacgtaaaattcacgttattattttatttgccatgcaatttagaattaaatcaggatgttggcagaaagctagctaaacccttaactgacatgtaccctctcagcaatgtaactaaggatgatcgcagtctggcacccatgctaggcatgtggtagaaagcatgccaattcttggcacaacataaaacagaaggaatttggtgtaggacatctggatatttagtactttatgcaaaaatacatagatcctttatttttccttctcttttgacatttgttgtacaaagtcttaaaaatttattctttggaatacataagttggccatattcatatgcttcttgaaaaagctatttttaaaaaacttttagttctagcatttaatgctggagaccagtactacccacttggactttgtgcagtgatagacacactttatatctgcaaaatctaataaagagatgactagctacgtgtgtccattgaacactagaaatgtacttggtgcaactgaggagctgaattttcatttttatttagttttaattcatttaagtttagatagccacatgtggttgatggttaccatactagtaaagctataggctattaacagtctcagtttaccagtggttaagactagctgaagtataagatatttcttaattacagaaggaaaattgtctgatgaaatattaaggacctttcatttacatgcattatagtgatattaaagtagtttcaaaatagaatagcataatattaataaatacacatgaatatatgttcatgcacatatagttttatacataaatatgtgtgtttattcaaaccagagaattcattaaatcggattatacagtaataatatacaaaaactgaaaaactgctataaaatttcatggctagaaacatgttcttgtcagtaaatccgtaaatattggtacatacatagcaataaagcataataaacttaatgacaaaataagtcccaccatatatgcagtaccaaaaagcaaaaatggtactatattttcatgaatattggtgactaaaaagtaaagcaatgtaaaataggtttgatgaaatttcttttaagataaccatagtttgcaaataaaattaatttatcaaaaagcagcaggaactatacatctagatagtaatgtttaagagcattcaatgttgttccctggaactcagaaaagtaaatttcttcttattattagataactagtaaaaagtgaacaagagtatttactctatgaattttaacctgtgagtttagtagttctatatcttaatctaaaattttaataaaatagcccaaattttatctctcctcagccttgtaaaatcagattttttgtttaattataaataatacaatgacaagctctgaaatccctgtctttgatgtgatgggggtggtgctttttgccatcagtaggggtaacatgccctccccacctctgatctctggagctgagctttctgttattattatttgcacactggacacagatctcataaaatagatcttagtcactggaaaatatattaatgtatggatttttcatacatatctaatagtccaatcaaggtgtcaacactgatgaggtttatatgtgtccctaggcgtacatgtgtgaagaggggggcatttggggaaagggaggtggaaaatgcttcacttgttagagtcatgaattaaatgatgcaagtctgaatctagttgcaaatattattatagcaatgaacaatatgatagttatatttaaaaaaacactttgggaaccaagcaaaaacaaagcaagctgcatttggaacagtgagatgctggttcctgtagccttcaatatgctttgtgattatggctaaatctgtgacgatagtttgaaaagatgataaagagttacatatttgcttgttttttcaaccattagttctaaattcctttgcaagagagtgcattgaagaaaagcacaagacaaatagtcaagagattgtgctatttttctgactcttcccattacgtctctgtgatctactacgaatgttgtccttagatctcagtttccttacctataaaatgagaaaattatatagatgacttcttactacattcaattacagaattatcctctggaatggaagagacaaagcactatgcaaccaataacatttccagagaaggcagctgtattagtttcctagggctgccataacaaattatcacaaaataggtggcttacaacaacagaaatgtattctctcacagctcttgagtctggaagtcacaagtcaaaatgagggcagggccacgttctctgtgtagacactgggggaggacccttccctgcctctcctggcctttgatggttgtcagcaatccttgctgttccttggcttgcagatacattgcgccaatctctgcttccgtgaggtcttcttccctgtgtgtctgtgttcaaatttccctcttcttatagagactccagtcagattagggccaccctcatccagtatgacctcgtcttgacttgattacaactgcaaagaacctacttgcaaataaggtcacgttcataaggagaggaggttaagacttgaacatttatctttttgactgggacaaaatccagcccacaagaagacctgaaggtacagtctatttcttctttcttcttttttttcttttgttaagttattttagtgatgttcaatctttacataaaattaaaatctttttttaaaaataagtgtcagtgccagaactgtaaatgaaaataatcaaataaaagttagaataattcgttactcgttgactttccttgcacttaaagcatctacaatgacaatctacctctgtatattaatgtagtcctactcattttaatgatattttacctgttttgattatggataagatcaatcatctttaaaaactattttataatacctaaaaattgttccaaagagttattctagatagtgaatataaaactgggaaatgtggtgcttaggaacccttgaagtaatatttctggttattgtcagaaccagatgttgacatgaaccatgaagctgaattgtcaaaaattatccttggttgttgttttttaagtagaaatgaaagtcctgctggaaggcctgatgacagttccttttgggactctgttgctctcccttgccattctgccccagtcatagcttttattaacaaacaaacacttgtgtgatatgggacacgtctccatggttagttgtgtgtcatccagagcctgacttagaaatagcccaaggagatcttctgaagactctagacttactgccattcaaaggcttacagtggagttacacctaaccaaggttcttaataacagcaggtgaggcaaaaaccctggagtggaaatgacacttgaaaatcccataaattacatatgaattgtccactcacctgaatagtggacacctgaatagtgcggtacgtgtcagtatcagtgggcaggaaagtcctcatttagttgtccagtcctgtggggtaaacattgttgtccttttcctggtactgaaacttagttcaaaacatttttgtcacatgcccaagatcacacgagaaagtcatacaaaactattatctgcagcgaatacaccaagtgtattcccctctacgtcctcattcggaacatcatctttccaggcctaggcagatagattacaaaaactgaaactgtggaatccttgcattgtaactttttaaaaaattttactttagcttctgggatacaagtgcgaaagatgtaggtttgtcccagaggtatacgtggcgcagtctattcccctgggaggagtcacaagcctcaaagaaagtagtgagatagttctatgatttacacatagaataaagaaaaatggaaaagcaatatgaatataatttgtattttttgacacaaagatgtgcaaacatacataaagatatacagcattcattgtaaacgctagaaataggaaataaagccaacataaaaccataaaaccctattttaactttaaacaaaatcaactcatttgcttggaaaggcatgagagagtctcaacaggagaaatcaactggaagagccgggagcctccacaagatccctttttacctggattcactgtaggcctaagtctgccttcagccttcagtgctcagaggctgggatctcagtcttgctgagaagttcagcattgctgggcctcagttgtgcacccagattagtgcagttcaaaagaaatgagcatagccacacagcatttccgctaatttccagtgaaataccttatggccacactggccagatgtcatagtagttgttcagacagcctcatcctattgtaagctgcatggtaaccagccaaagaaccaaaaggatgtgttgtgaatgcttaaggacattgagttttgctagtcaggcgcatctacctccacaatagccagtatttgttaaacagcctagagacttgatttaacctgacctctctttggaaaattcagtgatttggaccaaacaaccatgcagaatataatttcagagttagaatacacatcttttttttctccgtgcttcctgaaatgatgtctatgggtgacagagagcaaattagtttggggagggcaggtccaaataaataatatcgaaggccctgacaggggacccagcctgagcatgttcatctttattctctactgtttctgcacattacattcttcctatctcaatggatgccagaaagacaaagatccctgaagcaaagtaaaatgtctgtgtgtgtgtgtatgtgttatatgtgtatacatgtagattatcattatttgtggatttgatttttgtgaatttgcctacttgctaaaatgtatttgtaacccctaaatgaatacttggagtgcttttatggtcctttgtgaacatgtgcagagcagcaaaacatttgagttgatcaatgcacatggcccagctgaagtcaatcaaggcaaatgtcgtcacgtggcacatgactgttgttggagtacatcaaaactaaaaacttgtgtgcgttcaagagcgctagcaaataaaaggccacccagagagtggaagaaaatacttgtaaatcatatatctgataaggggttaatatcctgactatatacagaactcttacaactccgcaacgacaacaacaacaaaacaacctgatttaaaaaatcggcaaagttcgtgaataaacatttctctaaagaagatacacaaatggccaataagcacattaaaaagatgctcagcgtcactaatcattagaaaaatgcagatcgaaaccacaatgagataccacgtcacacccattaggatgactactattgaaaacagcaacagcagcaatacagaaaataggtttttggtaaggatgtggagaattggaatacttgtgcgttgttggtgggagtataaaatggtgtaggtgccgtggaaaacagcgtggcagttctgtaaaatagaactgccacgtggtctagcaattccacttctttgtatatacctaaaagaattgaaagcaaggtcttgggatttatgcatccgtgttcacagaagcattattcatgatgccaaaaggtggaagcaacccaagtgtccgttgacgaatgaatggataaacaaaatgtgctatataaataccaggtaatattattcagctttaaaaaagaagggaattctgtgatatgctgcaacatgggtgaaccttgaggacattatgctaggtgaaataatacagtcacaaaaggatacatacagcgtgattccaatgatatgaagctcttagattcatagataaagaaagtgcaatggtggatctcaggaaaggaggggaggctggatgggagttagtgtttaatgggtatagagtttcagctggggaagatgagaaagttctggaaatgaatgctgaagattaagtactatgtgaatgtacttaatgccactgaatgtgaacttcgaaatgtttaagatggtaaattttatgttttgggtattttgccacaattagaaagaaaatatacatgattaagactgtggaatttaacattgtaatgcagtcttctccagtcgttttaaccattaaaaccacccagtcagtgtcaatggcatgtaactgataagaccttggaaaggaaaatagaagaacctataaaatcgaatgattcaaataaatgtttctttggaagccaataaaatcattttaaagggaaaaagctcttaaggaggaatgacacaggttaccccattcctaacacactgggtaatgagaataaggttcaatatttcagaaaagcttatacatttgaaaagaagttaattcctgctgtaatctgcctttcatagagaattttaagaaaggtaatactctacctccttcaaaacacacacatgaaatattcacacacacattaagagaagctctaaaattcttggcgctgaagagatgaaatgtggatgtcctgacaccttatttgcacagtccatgcctgtatagtctcaatttgcatttgcacctgcaaatggcttttttcctgaaaaacaatttgtatgttcagctatttattttgcatatttcaattcatatttggcatgcatagcagcctgtgtgactgttactgaggggccaatatttgcaagtcttatctgtgaacatgaatgtcccttgggccactttcggtttagccatgggactgtgttaaaggtggatgggtggcctctgcgggtgagttaagagtggcttggctgtggaggccttaacttcagttagttgcgcggaagtgcctctgggaaggctttttctgggttattgagtaagctttagtatttcggggagtgatctgaggtgtggaggaagaaagcaagccagagcctccgtgtctttatgataatatactccttcctagcttcagccttagggcccagaggcagtttttcaggcaagcatggagcagtgggaagaacaggcgtggtgagctggcagctctgggtttgaattcggctcccttgtttaagagctttgtgatcttagtccagttcactgaccttgctgaccttcaacctctctatctttaaattggaaataagactccactcacgaggttatgatgtgaatgcagggagatcatgtaggaaaagctggtgaagtacccggcgtggagtatttgctcaacaaatgagagctgacactgccgttctcattttattcctatggatttgagaaggatctgaggaaaggggatacgctcttctgagttcaaaagagaccctcaacaccgagggatgagagggtcacagaggaaacacgggtgctttgatttggcagcggtcagcagccagacaggtttgtctgatttgcagcttttaattatcactctgataattttagaatgggctggaaacaaggcggtcgccttcagagaccaccctctgaaaccaggttcatctctgaccctgaatgaaaactccagcgaggcatcattatgatgactgtccatggcttcgctgtgttaagaggtgccctgcccttttaattggactgaatagagttcctgagaaacctcaggttgaattactcacgtctttgctgctaaaattgcacaaagatataaacttgctgctttacatgaaatctgctggagagatttaaaatttatcaatcctcttagctttgctgcttttaagaacaccaaaaaatggcctgtctcagagaaaccttgcatattacaattcagtttttagacatggcaggagctcattcacagtggaatttacttcacattacatttggggcatgcatgagatttaaaagcaatgcttttcctctaaagtactcactacaaaagatatatcacacatactcgggctatttaagactcagcaaggggaatatcaacagatttttctccaagtgtgctctctgatcagctggggaaataaaatctttcttgaaaagcaacgaattgaagcaattctagtgcattaaagcctaggggtctgtcctgtttggttggaatttttggcagctttgaatatagaagtagtgtttatataggtgtatgtgtatatgaatgttatttttgcccctttgaatggttttctgacttacataccttcagtgttttattaataaaaatatttatggctcactgtaatcccagcattttaggaggctgaggcagacggatcacttggaccaggagttcgagaccagcctgaccaacatggcaaaaccctgtctctactaaaactacaaaaattagctgggcacggtggtggacgcctgtaatcccagctacttgggaggctgaggcaggagaattgcttgaacccaggaggcggaggttgtagtgagccaagatggtgccattgcactccagcctggatgacagagcaagactccatgtcaaatatatatatatatatatatatatatttttttttgaccttggagtcaaacatatatatatatataagaaataaaatgccattagcaatttttttggcttgaattacttatgtatcaatcaagaatccatcaactgtttgtaatagaatcaatctagtactatttttcttaaaaagaaaatctatgggctcttcagttgggatattcaagagtgacagattcagatatgatatgatctgattcaaaattatcatcaagattacccttttgccctgactcttgattttgggctgagaaacagaatcaataggatagactgtgtgtgtgtgtgcatgtatagatgaatatatgtatatatgaatatatatgtatatagatgaatatatgtacatatatgagtatatatgtacatatatgaatatatgtacatatatgtatatatatgaatatatgtgtgtatatatattatatataatatacatattatatataatatgtatattatataatatataaattatatattatatataatatatataatatatagtatatataatatatataatatatattatatattatatatatatatgaaaagagaaagagagagagagattgagaggggattgaatgtcacagggcaggatggcagcggggagcccaggaagagtccatgtagctggcgtctgaaggcagtgtggagatggaattccttcttccttaggtgtgggagatcagtcagagtggtgggagaaagcctaactggacttaggtgatctcagtctttttttgaaggcctttgattgattgcatgaggttcacctacttataatatggagggtcaggtactttactcaaagtctaccgagttaaatggtaatcacatctaaaaaatgccttcacagaaacatctacactgttgttggaccaaaaactgggtaccacgacccagccaagatgataaaatgaaattaaccatcacatcatccttctctggaaggttatcctgcataattgcataggtggtggcagggagctgtaggcttccattgtccttatggtttagcaaccccagcaagagaaagggagtgagtgcctctcttctgatcatctcaccagagttcctggtctgacctgttcacgtgtctaaatcaagaactggggcaggggcctggggtttactgatggggcaggctgctgtctctcctctattgctgctagagagaagtggtccatcagccccagcataggtctggggaacactttcctcattgaaaagggcgtagtcccagaggagggatgtggggagcccgctgggcaggcaaaggactccctcctgtcatctcttcagagcaaactgtggtgcatgaggcaggtccagcccactgcctatttttgtatggctcatgaactaagactgggttttccatttttcaatcagtaaaagaaaatcagaagaatgatattccttgacacacagaaattatctgaaatataagttctgtgtccagaaatgaaattttattggaacacacttgtgcccacttatgacgctttctctaaacggccgatttcacattgcacagcagagctgagggcttgtcagacacagcctggcccgaagagcctaaaatatttactatctcgtcctccacagagaagcatggctggctgtgttatcacattgcaaccgcaactggaatttataatactaggtattttcaattcaatttggaagcatatgtttagacacatgcatatttgtttatttattctaaaactgattcctcatggagagtatcaacaatttcaatcgtggagaaggttacaaactgaaatgctaaatttctttccatttccatctccaagtccttctttctagatgtaattcctttcaccatttttttaattttaatttttttggtggctataagccctaattcaatattatgctttcacttgtttcctggttgaccagcattaaacatcagctacatgctataacagatgggaaatttagttcctattctttcctccttacagtttcttacagaacattttaaaaattcaagtttatatattagttatatttataacatcatataatatatacttaactctatttttgacctatggaatttagaaatatgccttgtcctcttgctcagtaaagaaagaaattttgggctctgctttgtcttccagcttctgctgttttgactttaaattttgacgattaatggcagttatgctctgttctgtaaaattaatctcacactcttgatctccaagttgaattaaattttcatcttattcagtgattgacaaacgcattttatctcaagatgcatatcttttttacagctattactttgattattgcttcccatcatttttgttctctttctctttaattcctattggatgtgtttccttgcaatgatattctaaactctaaaatttttcttgttctcttctttcctttggggcatttcctttacttttatttcacatacttttatttattctttaatttccataatctttaaaaaagtgtttactgcttctttttatagaagcctagtacggttttcttgtgtgtctgtcagagttgatctcctcttgttgagtctctttgaggttactgctggcattattttaatggtctcctcttttccctcaattagctgtgtttcctgcagtggggttgttctgtttctctcccgtggttcttctcgtttgtgttactgctgtactgctgttccttaagtgtctgctgacctgcagctgtcccttcaaatgtgtacgcctggttcgggtaacacagctccttgcactgcagcttcctccagcattttctgagtggtagctcgctctgttctaacttgttcactaatgtaaaaataataatagaaagtagggatccagtgcttacaatgtagcagacgctattcaaagcagtttagatgaatcattggatttaatcctcatgaaaatcctagccaataggccttactatcattcccattgtacagatgaggaaactgacgcacagagaggttaggtaagttgtctaaagtcacacagcttgtgagtggcagatccaggtcctaacccacgcagtctcgcttgagcaaccgtactccttcctcttgtgtgctgagctatattgatctgattcgtgggcacttccagaatttaaaaaatcttcagcctgctgatgtcatcctgcaagttcttgcaatttttattttgtcttaattgactccatgtggtacgttaaaactgttgtttaaattttttttttttagtaggaagggccataaatatgtgtgcccagtttactgtcctggtgaaagtctcagctgggcttactgtgttcttatcattgtgttgatcaccctgagggaagtgggaggggtggaggaggagagacagtgccagattcccagggggaactttcagtggcgggataggctgatggacaaacgtcatattgctccactgttctttattttctctatcttcttctgcgttctgtctgccctcccttctgtcttagcggttcccatacagccttcaaaaccaatctcctccaagaagcctttgctaattctccagcctgagttttgggctctgtgcttttcctgtgcctagtgcacgcctctattacacaccctctaaaaatgcactctctcatggcctccccgagagtctcagcacatgcagggcagggaagtgctaccgcccatgcccagcaagcaaaggcctggcctttagccattgtccattttttttttttccagatgagtgagtgaaagcaactaatataaaaggggtcgatttcttatttccaaatactttgcaggaatggggtttattcagataaataagatatctagtcgtattgatacaaatccggctgggctgtggctgagaaagtgatcacacatgaaattctccggttgtcctctgagttctatgcagtatggctggacccctaggtttctgagtccagccatctgtgttatattgttgagttacagaagactgcattgccaaaccaatcttttcttttttcttttttctttttttttgagatggagtctcgctctgttgcccaggctggagtgcaatggcactatcttggctcactgcaaccttcgcctcccaggttcaagcaattctcctgcctcagcctcccgagtagctgggactacaggcacctgtcaccatgcctggctaatttttgtatatttagtagagacgaggtttcaccatattggccaggctggtctcaaactcctgaccttgtgatccacccatctcggcctcccaaagtgctgggattacaggcatgtgccaccacgccctgaccaaaccaatcttttcttaagttgctattttgcatgatttttttatcttgggagaaattttaaaacatagtcatgaatgactgaaaacatgatctgaatgctatcaataataaaacctgaaaagggagacaaattggttagtgttttagagaaactgaattggttctggtttctgagctttgcgaaataggcctataccagccttcaaattggctaccgagactttccttgaacctccagctctacgacactggacatatgaaataggcatgtgacatctgtggcactagctcgacaccctgttttatgactatgtctttagatctatttctatctctagaccgatggcaccaactcagtgccttttgtcattgcaacaaccccctcagtgctcctccatccttcagcctcactctctcctccagggtactctccacgttgcctgcaaattcagctttccaagcacagaatccatcgtgtgattcccttttcacgcattacattcttagaataaagtccagacgtcgctgcgatgcacctgagccctcccagtcttgcccggtaaagctttccactctcctctctggtagtttcctgtggctgctgtaacaaacgactacacactcagtggcttaaaacaacacagatcgcaatcttgcagtttggtagctcggacatgtgatgtggatcaggatcttgtggttctgtagctcaaacacatgatgtgggtctcactgggctgaaatcaaggtgttctcagggctgcatgtcattctggagtcttgagaaaaaaatccatttcctggtcttctcctgctcctccggggctgcctgcattccccggcttggggccccttcttccattgtcaaagccagcaatgcaggtcagtccttctcacatcacatctctctggcttcttctgcctccttcttctacttacaaggaccgtcctgattatgctaggctgcccagataatctccctatatttgggttagcttatagcaactctacttccccttatgaaacataacattttcataggttccaggtctggcccatggacacaaatgggggaccttactctgcctaacacaatgatacctcttgctaccatgtattccttgctctagtcaaactagaaaacctgctgctgttgctcagagcatcattcatatttacacttcccttgtgctcacattgctctctatgtctgaattataccttcctcccattctctatatattctcaaatgtcattttctccaaagccttttctaagtggcccaggcagcaatgctcctacctctaccatcccatgctacttgtttatatagttatccccattatccttggggaataggtcccaagacccctcgtgcattcctaaaactgcagatagtatcaaacctatacatactatatcttcttgtatacatacatacctaggataaggtttaacaataaaataataaatagaacaattataacaatataatgtaataaaagttatgcacatgtgatctcactctcggttgcctgccaataactgaaaggccagcaagtgaaactgccgaagaggggagctgctataccacccactccaggctgacggcactgtgtgctaggctgccattcccatcccacgtcaattcccggaacttgccttcacttaatcatttttgcatcttctctaatggccaccaaaaattgtgcacatacaaggagctcgaaaatacgtgtggccaggcacatccctgcagtcccagctactgaaaaggttgaggcagggcggtggcttgagcccaggagctcgagttcagcctgggcaacacagtgagacactcgtctctaaaatttttttaaacgtgctatatggaatggatttttaaatgtatgatgtctctgggagggaattatgatcttcatttaaatagttaagctccttctggtgaattctatttatggttcagaagttctatgtattggacagttccataaattgctgccactaggggatgggtggaaaggaagcaaagctgaaggcaaggttttcggtcatgaaggacctgcctattgtgtgtctccagtatttccttgcagaggctgaaagacgagcctccacgtaaccctgaagcactcagagtctcttcagcattacccctgggtttgcattctatgtgaaaacctatgaagttaattttctttttttttttttaattttttcttttcattgcacaagaataagaagttacttttctcatttgggagaacattccatttttttgtcttaacaccagactggtatgttttgggtttccaagagagatttttgaaattattctaccattatgattgatatatatttttaaaatgaagatataataaacaggcacttatgataacagttgttagtatcttttagtaattttttaaaaacataagttcccaaagaacaggccatttttcttcttctcaaaaatatgaaacattaaacaaggattatttctactcgttggagtatttaaatacagctattcaggtaaacattcataatccctcgtcacacagatgagaatgattctcagaaggcttgaaggcctttcccttagtctcagaacaggtgggctgatatccaatctcaggtctttctagcttacaagcacctgctattttaggtatgatgatcctgtgtcctaacatcatacatagaaaagactctgcatttgctttcaaaattaattattctgaatattactgaaaattcttatgtgatgaagtacaaaatgtataatatttggaatatggagttatgtagatctgagtaagttgctcaacctttttgaatttcagtctgttacgaaaaattagaaattagaaccctacctctccattgggtaaagattaaaaaacataaatcagttaatttatttcattatgttttatttcctactgaatagtttgaagacatcagagactctggtgccataaaatcccctgctcagaagcagcatcccccacatattacgaatgagaacaccagatgtccttcagtatacaaacatctgtgggctgtcacatcctcacgggcaaatcactgtatcacgtgaacacataacggactgacgggatccctgaagcgaattgtttataacgaagaaagagaagagagtgattgggagcctggagccctggtgcttggaggaagcggattttcctgggactggcacctgagtgtcttgtatcggtcacggaggagtcaggacagaggggtcatggaagaggctggcggggccgggaaggtgctctgcccccgtctcggggtccagggccgtccactccgcccgtggctgccgcccgtggctggctctctgcggagcagccagcgcccggtggaacagggctttctggaaggtggctgctctctgaccatgtcctcggtgccagccgggtcaggggctgctgtccacacttcccacttaagccagtatttaagacagagggagaagggaggagaaatgagggacagaggggagaggtttacatggggcagttgctcccgaggaaaaagaaaaggggtccccaggctgtctcccatggcgtccttcctggtgcccaccctctatgccctacctgcaaccccacgtgcgcatgagaggacggacgtctcttccagcctgaagggaaagtgcagactttccgcatctgccttgcagccgtatgttgtagaaaatgccagcaggtaatttgctaaaagttgcctgaggagttctccatggcccagtggtttctatctgcgagctgtgctcctcttgcagacggactgtctttcagtaatttgcagctatgtcatttttttaacttgtaatatattgtatcatagaaaaaaagtcaggctctgactatcactttaaaagcctatttcatccacgacgtggcaaaaattcccctttttttcatttattttctttttcagtcatttcaaaaaataaattatataacatttaaaatattttaatgtttcccattttgtttgtcatgcaatcagttgctaacaaagttatgaataacatgatgctcttcggtatatgaatgtattcttcagtaaacactgttgagccctactctgtgccaggcatcgttccctgctatttcggagctcacttgaaaggcactattgagagtccttgcctcgcccccaacttcccccaccacacacagattagagtgaacaggctttacattttttttttataataaacaatctatgaacaaacatatgaaccttggtatctcaatagcaaattatattgctgcttctatgtaaaaatatagcttttcccatgaaaacaaacagaggaatgtgcaagaaatctgacaggaacttcttctggctattttacccttgttactgtagaaactccttatgctacgctatttttattgtggttattttggctgaagtgtcctcaggaaacaactcagattcaatgtgatcagaacatttgctttctcctgttgctagagccatagtggtttcacctggcatttttcttttttaagagatggggtcgcctaggctggagtggagtcacaccatcttggctcactgcagcctcaacctcccagcctcaagcaatcctcccgcctcagcctcccgagtagctgggacttacaggcacacatcaccatacccggctaacttttaaaaaattgtttgtagagatggggatctcactatgttgcccaggctggtcttgaacttctggactctagcctccccaccctcccaaagtgctgggattacaggcatgagccacggcccctggccaacttcccattttacagagaaggaaggtagggcccgtgaaatgaagtgaattgctcagcatggtgcagcggtcatggacagatgaggctgcagtccagccctgctgaactttcccgtgcactgcagtgtctgtgaccttccacttgccactctgcagtgctcgtggggcttccaggccaatagctcttttgctgggaaaacagccggttgcatatgctgaaactattgcaaggacaatttggtaaaatcttgaagaccttaaccaaaatagtactagtaaatgaggctcaaactctccccatccatcaaattggaagctttttcattaaggctactactgaactttctttattcaggaaacctaatcagcaataaaaacccgactgatcagtgcaatatgaattttactgctgtgtggagacacggttttattttgccgtcaggaaaagtgagatctgactggggaatgagtgactctataatccttcctgcatcattcctgctggtcatgaaggcgccaatccaaagactgcgtcctcttagatgggatctgatttttaaacatttcctggatgtcttattttccttagatcctagatctgacataaccctaatgcatcttgcatattttttggctccctaatagtttctgagaaattccattccatttttattttttttggctgaagctgtggaaagacaaaaagagggggaggggagacagacggacatttagaaagtgtattttaaattgcaaattcagattgctaggctgcgtttgtacatggagaaggaagggaggaatgaatcaataattcaatgttaaaactggaatcctgcttcaattatgtgactattttaaccagagttatttcaatctgaccatcgataatgattccatctcctcctagtcctgagcctagaagttagctgggccttcacctgttcaaagggcagggtcctcagcgtgttcccttcctctggggccctagatcctcagatggcttcctttgcacttgatccaagtccactcactctcacaccagtgggtcagaaaattaggctcatttcttttggaagcagttgtttcccacggcgtagacatatgctatgaatttcacagttcgttttctatcaagatatttctaaacagctcttcttttattcatatgcttgtctactggggaaatcacatggtcacaccatattggtggaaattgttgctgaggggaataaaacttgatttcaaattttgaaagataaattggactatctaattagccttggtcaatgcaaaatctttgactaggaaagtaacattttcttctgatctggagcagagaaacaggtttttaaatcagtgggaacaagagaggggaaagacttccaagtgtgtccagagaagaagcagatttgttttacacaatcagtctgcagggagaacctctgagaacagacatgatcatctccagagacttttaagttactcacagccaagtggaacataagggcttcttattcaggaaaggcacttaaccatcttctaatataataaacagacagggacattttagcgttttaccaaagagaagtaagtaaacgtaaccgtacctaactctgtaatctgagctgatctgatgtgtaccatgtgactgtaacattggaagctgcaaggggacccttgcaaaatgcgggtaatgagagtcacctctgaatgaatgagcaagtctggggaagcaaacccaagcactgaaacgtttagtgaatggaaagggcctatgcatgcccttcacaaagttagaattgtggactaaaattagagttgaatagagtaaacctaagctttggaagatttttgatattgtgactttttttgtgtgtgctacaaaagcagcagtaagagcaataaaaaaaccatttcccttctctgtagaatcacaccatattaagaacatataaaaactgtgctatcaaattaaagtgtaaaactaagcaactgggatttagaaatatcatccaggagtttgaatttttaactagaaattagctctaaagaagtaaactgtaaatgagacaactggtattgaaaagtcttttcagggagtcagaagaatttaaccctagttccatctctattaaatagtttgttttgtgatttttgtcactccacttaatctttttaggtccaggtttccttatctacaaaatgagggcattagaccccgtgccttccagcttcagtatttctctgattttggaaattttagatcaggcagatattggttcaaatttagagaatctgacataaaaacttttgtaggagaatagggtaggaagattggcctaaattattcagaaatctgccttactattatacatcattttaaacccatgaagagtaagaaattgttatgaattatttaacaaaacaaatttgtatttaaaataattttgctgagtactggtgtaaacaggctatctgctaaataggggataatgacaaatactctgcatttttacagatattgaaaggtggaaatgttctctccaacacactaaagagtaatcaaaggaactgatcctaaaactatgtgttgtacaagcaaaggtaaggggtcagcgctgtcgtttctgcagtgtctcagtctcatcacagaagtgaggatttatggtgaaaaggagtttaaagtttccattgtaaagaatgttccttcaaagataattgaaacgaaattttacaagtgaaaaggaggaaataaaagcagaaatgtgattcttgaaagtatagttgaaatgtcccagttattaacctctctgatactcactgttagtgattcatgtcatctctcaaccgccactttaataattgctttattagtgcacactggaaagattcatattaagtgatttttccacaagggcttctctttctcctctttagtgaactggactgtaaatatgtgaatatggtagctgttttgctagccttttgtttttttctgaaactcagcgaataaagttgaactttggacatttccttatgtatttttcttcagcatatgaaaaacttcctggcacagttttctgtccggggacaatacattttctccactcctgatggttttttccaggtgaagggagatccacggctgtcgtaatctttgactttctccactcctggtggaataacttagctgattgattataagtttggagaaatctagacgtttcctcttcattgtctcttaatagttaagtttggacatagagggcatatatttatctctgttccttcaagttttacaggggctgcctgtgcttgaatgagtaagtctgtttaaaactgggattcaattttaggaggcccactttcctccagatttaagccaatatccttcaacctaaattttgtccgtaatcaaggcaataatctggcctcatctaccttactcttttgtcttttttttttttttcacagaactgtgttctgtggttaaaaacacagttgcagaagatggtgatttttaaaaagttggactccctggtgttattgtagtcctttatgaataataggaaaataggagcgatgaaaaagttttacttgatatcaaattgtaacatcattattgctctgcagcaaacacagaattacattccaggatttaagtattaaatgatatgtttttaaggtctaagaaaggacatttgcttcccgattgattgcattaatataaagcaatttaacacatgttaactacagagtcagccagacttgagtttaagtcctgactattactaactagatggtgttggagacttcgctcaaactgaacttaagttttttccaacagcaaaatgggggaatagaaatcaattattaataaaaggatgcctatgaggagcgccataaacagtaccccaaactccccctcccacatacgctccttttcatcacataaatagtgtaaaatatattgacaaatggcatgatcatactttggcaaatagtttctcatgaaaacatttttggaaatgatttctaatagaacaaatgtaaaaacaaagatatttatatgaagggtctatttacataaaatagaaatttttctaagttaattgaaggaattaccatacttttttttttcgtaaaactcatcaacattaaaaacaaaagtcatctccaaacttaattattgcagaaaaaagttggttggaataatgctttaaagtgtacatcactttgatgttcaaagactcctgattagagtgtcctttctataaccaatcttgttccttaaaacatcttgaatgatttgatctcagatcccctgaagggactgctgagatcatctgcaccaatcctaaaaaaaaaaatctttcatgcccaaacccttagcaaagctagtttcttgtgggactcttaatccctcttatcctgcttgacacagaggtgctcacctgctgtgcatcagaaacactatggatacttcttgaaagtgcctgcaacagagatactgatgcatctgttgtggggtgggccctaggtatcagtaatttaaaaagttttttaaaatacgccccagataattctgattgcttgtaaatggcaaaggttgagaagcactgctggaagcttttgagctcctgttgggtaagttcaagcgacaggagaatctcatagtgatcataaaacagcactctgaattcttggagaaacccagactcatcttatgtgactaatttccttaatgtgtaccccaaaactatcctagcgcgttcacaggtacaccaggtaatgctattctgattgagcacccaagagtctcatttagaactaacatttttttctgttatgtaaacaataatgtaatcctgactcaatccgattcgtttattttactctatctgtcatgactgctgttaacattttttcccaaaacttgtcagcaaaatgttaaagggaaactcaaacattccataaacttcctttgactattcaccaattccattcttttaattacagatgtgatttggtttctcttattcccacctggtctattttgcactggataaagattggttggggtggtggaggcgtatttcaagatgttctccagagctgacccacatcccataggatttaggcctacaaagaattcagtgaagcgttaaaacaagtaatacactagcacagttggcgagctcaggagagctgcccggcagttcgggattgagggaaatgacaaggatttcttttttcagggtgggatgcggttgccctattctgctgctgaatgtgttccgaaaaaaagcccttctaggtggcggtttcttcggggaggtatgattaactgagcaagactgttctctgttgtggttttggaagaacaactgggtatggccactgtatttaaagagcacatttgtttggcctaaataccagtgtctttctataaccacactcgagtttagatcagtaattcatttaatttctgatttaaactcatggcttgactttggaaaactatgcctggggagaagaaaattaccagagcattcaccatctccaaaacagctttcggcaatggaggaccgctacttgtttagcacatgactttggagaaaccacaaagctcgaaaatactaatttttttcattagagtaccagaaaagtcaacccaacagttttaaacagtggtttttatatactattaaaagctctataataagcaactttgggaatcaggatgaaagctaattatagaacttctttgccatggctgtttctatttacatcttcaaaaccacagaagcaaataatgtaggctttcctaatacgtcagcatcttcttgatttctgagttctttgaagctgccctaaatctttcccttgaaaacacattgtggttgaatattcccagttcaaggacaatttcagattagagtttttagtccaagtatactattctttccttgaaatactgaatctcaggactcagacaaaacatcaaaattgttactcaacatggtgcatgttatccagtcccttttgtgtgggtttaattttttgtgtgtttgcttacttcatcagtagcagcaaaacacagaagaaacattagtcaagagcatgatgtatctgctatgtcctgatcttttccaccaccaaaaggcaggtgtaacttatgagttgatttttaagaaaaagaaaatgttgaaagtgaaagaaactgtttagagcaaacatttcaggatattgccctgtctagctggattgaatgtttcagcttcagtcttactcccaaagctttgtagccaatttacactgtggcaattgactcagttggcctggagagctattatgaaagcaattctctccagtgcccagccttgcagacacacccaattgaccccgaattaatcagtacccacctaaaccacagttctcagtcctggctgcacatcagaatcgcctggggagctttttaacaatccccatgccaagtaattaaatcagacccattaaatgacagtctctgggggtgtggcccagtcatcagcagcttttacagtttcccaggtgattactgtgggcaggcgcggctgtaaaactgcagctgtatcgagagcacatcagtgaggttccaattccttgggtatttccattcttccttttacatggtgtggggtaagaggctgcctcggactcccagaacagttccccatttttaaaatgtccctgaattgggcaaacaaacagcctaatagaaaataagcaaaagataaaacatacacgtccatcatagatttatggtctcctaatttcaatctcgaaagtaatcagcatttttctaaaaggaaaatctgtatgtacccattattttgtagcaatgagtataaagtatttaatatccaatgcctttgggactgagggaaaagagatagtcttgcatcttctgcaggcgtgaaaatactactactggtactactgaagtcgctaatatttaataagccagggcaaggagccaggacttgctctaggaactccatatatattaactcatttgatcctcacagcaatcaagtgaggtcaatatcatgattatccccattttcagcagggagatagaggtgctcctgaggtcacacatctcacgaggtgagggagagggatgctgagtcgggcagtctaggtccggagtctgtatacctggggactcataaaatggtagggaaattgaataatctttgcccatagccttacataggccccaagatagcaaaagtcctcttttaggaaattatcttaagaaaataactagatacatgtataagtatattcattagaaataaaataaaatattcaggaaaataatgattcaaaagtccacacatagggggttggttaagcgaagcacattacagcatgtcatggggccgtatgttcccatttagaagctgtgttgtaaagtggttcttctcagcccttttcacgtcatgaaccataaagtgaatgacagtgtttttaatcacactctatgttaacactcaagttggctggaagtgactgttttggaaactggtggcacagcccccactagctgctgcaagagctgacggcatcaaaatcttggtgtgcccattcctcgtcaccaaagaccagtcacaaagttctcatgtataggaatatattttgctgtaggagagtgttccctagattttgctaagttcagaaaaggcatactataaggaagcaccttgagtatattccaggctgttaactccatcagtacatatgggcacagatggtcataccaatggttaaaacatcaaatgaccttcatatcatgggtgcacagccagtgcaccaagaaccccaccaccatcaccactacccacacacagggcttccctgaaatccagcagccctggaccacctcaaggcaaagcaaccaccaggtaaagcctaacttggagggcttggtttcagtggtgggaattactgttctccatcagccaacatgtgttctgattggttggggcctaagcttggcaggtgtttaaatgttttgaatattacatgtgtacatgaaaagaagttgattcaggggtacacatatatggtttgatagaagaaataagacccaatgttagctagatcagtagggctactacagtttccagtaacctattgtccattttgaaataggtagagaagattgggaatggttctagcataaagaaaaaaacaaagatttaaggtgatggatatttcaagaacactgatttgatctttactaactatatgattatattaaattatcatgtgtaccctcaaattatgtacatctatcatgcattgataaaaatgcatcaataaaaaatacaaattattcttaaaaaatctaggtggagaagagtttctggagggatatatgtcacagcattattgtttattcttctcttttctggatttcccactcttcagctttgggcaagtgtatatttagaaaaaataaagaccaaaacatcatttttatttggaagtaaacttgcaattatggctgaatctgattccttcaatcctattaacttacaaaagtatacttcgtctttgtaagcatcagaaagttcctcagctagtggaggaaagttcccactgatttgaactaagaatactggatgtcacaatgatgacctaaaaatcagaagatcttttccccattttttagatactacaagaaattctcatattcatgttgaacgctagagagtggaaggggccccaggaataagtgagatggagtttcaaagtcaaatcattttgatttaaaaacaatttttaaaaatatggtatatcttctacctttagactgtggaccaaagtctcatgcaagtgcataagtggtcagggttctttctatgtgttcccatcaaagggctcttccagtctcacatgggtttgtgccgctgtggaccagggtcagcgtgattgcagtcagagaaggcagcaacctgtccgagtggcgcaggtcagaggccctcaaagtggcccccgatcagcagggctcctgctctgcctggcgtaaggaaataatggcatctcctctgtgcctctcagtcccccttacaacttcaatgtaattgcaaagggcaccctttagtattgctctcaatctgcacttctaaattcacaaaaaaaggtctagcttttccttaacaattgtttggctcagaaggcagccaaaaatggttccatatagatttatacgtgattatctgctaggaattctttctcccagaaaatacttccatgtagccacctggctgtaatgggaaattgcatgttcttaccgaaccgctccaccccatctaacatgacccaatcgtaattcattttccttctgctcaaagtaggcttatgaatggacatatgacccaagccaagcccatcagaatcctcctgggtttctctgtgtgttttggttatatgtgcatgggtacctgcaagtgtacgtgcctgagtgtgtgtgctttacaggaactccaagaatcagtccccttttagtttggggaactatcacatgtacaactggggagctggcggtggccgtaagggcacatctttcataaggagaaagctgcactcctggacaagagacagaagcagaggtgagagatggggaggtgctcttgttgtttttaggcctgactttatcctgccccttctaatttttaatcaacctatttcttggattctgtgaggtatttcagtttgtgtttgtaacatttagaacctgaagagtcatgattaatgcattgtcttccctattttacttctcagcttcctttttgccccaggataatgccctaagggaattagattcaacaaagtcacttgttttgagaagcaaggagcgagcagagagaatttgagggagggagaggtgccgccaggaaaggtggccaagagcagcattaaggtccccgagggacggggccacgagaataagagatgcctgagaggagtagcaggacagagaaaacagagtgtgactagctcagcatcgtgccaaaggccctgctgaggtgctgccagcaggtgaagagtgtgactagctcagcctcgtgcccaaggccctgctgaggtgctgcttgcaggtgagttagtggttagtggtttttctgtcttcacatgttatttaaagatcatgttatttaaagctagacaattttggggaatgtggaagtgaaggctgataacaatactaaagggtgccctttgtggagttttgaagttgtaagggggtactgggaggcacgaaggagatgccattatttccttatgccaggcagagcagaagccctgctgatcggggccactttgagggcctctgacctgcgccactcagacaggctgctgccttctctgactgcaatcacactgaccctggtccacagcagcaacaactccctggaggctggaagaatcctttgatgggaacatatggggagaacccacaggtgcatagctacgcacttgaatgagactttggtccacaacctaacggtagaagatacatcccatttttaaaaattgtttttaaatcaaaatgatttgactttgaaactccaactcagtcatttctgggtaccactctctttctttaggttcagcatgaacatgagaatttcttgtggtacctgggaaatggggaaagaatgctcttatcttttggttgtcatggtgatatccagtatcctctttatccctgagagtggtacctctcatgcagctgcttcggcaactttcttggtgctgggagacacagcgcctagagtttatgcttctggtggaccccagagcctttcccctttgaagtcttgtcacttttctgaaggcttcccttaggttgaggcacaggtcactgctgttgaggaaatttgtcaatttctatgcctttctataaggaaataacctctttctctctctttctcttttttgttttgagacacagtctcaccctgctacccagggtggagtgtagtggtacgatctcagctcactgcagcctcaaccttctaggctcaagcaatcctcccgcctcagcctcctgggtacctgggactataggcacatgccacacacctgggtaatttttgtatttttttgtagagaagggttttgcgatgtttctcatgttgttcttgaactcctgggctcaaatgatctgcccaccttggccttctaatgggctaggattataggcataagccaccatgcctggcccatctctctttctgattagcatctctgaatacccctatgcccactccactggcttcccctagcaaagcaccctaaaagagctcaggcttttgggactccaaatccagaaaaggaatgtctttaccctctgctttctacctggaacccaaactttccttaaggcaagagaggacaatgagacccacctgcttgtcacgaggaaaaaattgtgcaaagacagctaaaatacatttcctctacagtacatagccttcactgactttcagttgtgagctgcttttgaaaaacacaggacagaaataatgagtgctccatccttcttgcctttacacctacaattcctgcgtaagcccagagtttccgcccagcccttgggagactgtcagactttgcctggcgctgaatctcatggtgaatttgctatggtgctgaccttgctctttgtctttttattcaaatatttgccactgtgcaacacaatcatatattgcatctatgtagtattgatattaaagtgtttagccaattaggtagtttggtattaggtaattcaaaaagacttcaaaataattcatttattaaaccgtattcttttctagtgaacatatgccttaagaatgcttccatttctcctgttggtttcaggcaggcatcattatgcacaaggtcctgtgttgtttaggtggctcagaggaagagtggaagtcaggcatatttcaggagtttaagttaaaacctgtcccaggggaaagaatgacagagtggaacagaagcaagcagaaagctgtgttcagagtctccagggtgcatgacagaggacactgtgtgcacatgtgtgtgcatgcatgtgtatgtgtttgtgtgcattatctccatacacacacacataaatatgtgtacatacatatattcataatcccatgaccatactcatttttggccttctctagaatcataaatatatgtactttctcacatttacatttgaatgagtgtattgaatgaatggtatccaaggatatatttgaacaagcaaagtgttaccacaacattgcactaacttggaagttgtttgtcagaaaactaaactatctggaacacagctaagaactaagaagaaaacaaaacagatgtctcagaacacttgagtcctgggcactttatttagaaaagtgtcattttcgtgtgtttccccttatgttacatacagttcaactgagccaggccttttgatttctgtgatgaaaggccttgaattttggagccagaaggtcttgggcttgaattcaagcaaattaactcttctgaggtccattttcttaatccatacagcagaaatagttacatctgtgtataaagttttattatgagaattaaagaagctaaatatgaaaagaatctagtggaacctgacatataaaaagtgttctttaacaggccaggaagggtaactcatgcctgtaatcccagcactttgggaggccgaggcaggtggatcacgaggtcaggagatcgagaccatcctggctaacatcctggtgaaaccctgtctcaactaaaaatacaaaaaaaaagtagccaggcgtggtggcgggcgcctgtattccagctactcaggaggctgaggcaggagaatggcgtgaaccgggaggcagagcttgcagtgagccgctcgtgccactgcactccagcctgggcgacagtgaaagactccatctcaaaaaaaaaaaaaagaaagtgttcttcaacaataatttgtttctttccccttcttttcccagcttatggaaaattggaagcaggagaagagaaggaggattcaaagatggacagaccaacgacagtcagaaagaacactccagcctaatagcctaaccctaagagatctcaggatgagactaatgagaaagacccaggtcctcactggcatctgaggccatgactgggtcccagtaaccaagaaaaggtggagccatgctcagctggtttctcagaagtggtgaggcatggcagaaacttcagcactgctcctccccaaaataaataaggtaaaaagaaaacattgggggcagcaaatgaaactttgctcagcatagaggacagctgaggtgttcacatggcaagaagtggatctatctggggggctagctagagctaaaccacttccaggagcaggagtccacaagctttttcagtaaaggtcagataggaaggatttcaggctttgtgagccacatcacgtccctgtcacctattcttcttgtggccacgtgtcttcttgcttgcttgtttcttttgccactcttaaacatgcaagaaagcattgttaactcacatgctgtccaaaagcaagctatgcactggatttggcccgtatgtcatggtttgataacatcacctacagtgtattacacaagatgacagcatcgagtgccttttcacatgtgttccatgaataaatgggtaaggtgcatatgtcctgtttaagtcatcccactagtaacaaaattatcctccttgtcattttggataaatgcattcattggcgtttactcatgtagatttgcctttgcttatcaactagaattttaatcagccaaaaaaaagaaacattggcactcacatacatgtctgagagaacagtaaaagtccatcacataataagaggtagcatttattgtgaagttactgtgtaccgggcactgtatatatacttgttaggggctgacttgtgtccccctaaattcatatgtgaaagccctaacccctaacgtgactgtttggacacgggctttaaagaggtcatcgaggttgaatgaggtcttaatggtaaggccttgattcaataggaccagtaagaagaagggacatgaggagtgtgcacacacggaggaaaggccatgtgaggacacggcgagagggtggccgtctgcgagccaggaagaaagatcgcaccagaagccaaccctaccagcatcttgaccttgggctttcagcctccagaactgtgacaaaataaatgcatgctatttcagtcactcagtctgtggttgttaccgtagcacaagtggactaacacagcactatttaattcctaaaatgtgttataaggaaggtgctgttgttatagtgagagaggagatctaagggcagagatggattaggtaacatccccagctggtctagctagtgagtggcagagttgggactgaaccaggcaacctgctccaggacttcggctcttcacctgtccctcggtgggctctcaacccaggtggggaggttctgtgggtgctctccccttcacaggaaagatagctcttgctcacgcaatagagagttctcaaagtgcttcagcgcaggacctcctgaggacgtctgtatacctcaggcatgcccatctcactgcttccaaaaggagctgaacaaagtagggactgaatggacgagtgcttggtggggggtagatcttggagtctgcccaaaggaagaaataggagccatattttatttctctccttatgccttatataatatgtatgcacttacaatgtacaccatggtgacttttgtatagacattttccacataaacctttttttttttttggcaaaatgtaatgtgtactaaaggaacgatgaattttccaaagtaagccagtctttcagaatttcatagctgtgaaggggataaagcagacttacccatgcaagccagcctttctcttggctgccctttcctaccctggactttctctcctctggctcctgatctctgaacttagaatctagcctgggctaatcctcagtggtgtcacactagagaaacgcccaggctcagactttgacatttatcctgaactgaattaagttctagctgattgcatggtcaaagattgttgctgtgatgggaagactgtgactcacatggtcaggggttggaattagagcattcccatgtcaccaaggtgttcacgtggcctgcagtttaataactaaaactgtaaccgacattgtcttgattgggcttatctgaatgttctgaataaaaaatgccaagtagcatgcttcaggagggcatggaaaaggcccacatagaaagttgccctcactgggccattgtttggtaaaatgacgttcatttcattgagctccccagagcgtgtaattttggttgtatgaaagtggctttctgaaatgtccctaagcagacatgttctatttcttttccatgaaacatgcactaaatacctataataggtacacagggggatcatggtggaaataaagcctgaaagatagatattcgacttaatcatttgttaaaagataattttgagtgggaaacatttattatatagaatcactgactaacctggtatatttttattctcccactcttaccttgtaaagttgatatttaaaggtgtcaaatatatggctagtgtgccttatttgacatggaaaatatgaacttatctgaagtaaaaatcaccttccctttgggctaagaaagggcttggagaggagaaatctactaagcctccaccaattatgatacagacccagggagctacacagtcacagaaactcctgggcaatgtctcattattatgagattttcagatacagcatttttttttaatccataaaggaacaaattgaaaggatggggcaggtggtaacatttagtttaaacttttttgaggaaaattaagtttcaaattagaaacttgaccaagatattgtactgatggatatggccctggagtctacagtcaggcttcccagtctatatatagtctttgaacaggaatatcctagaagtctattgccttcaacacatggcgtttttggatcatagaaaatggtgcagctgtgtttggcccagtaggggtagtgacacaagctgaactgaaagataaggtggtggttacggagcatggaggcaggcggccttaatgccacggaggctgagaggacactaaagggtcagaaacagaggaacaacatgagagatctgtttcaggatcatctgtactgaatcagagattcaatgtttacttccatgcatttcctttctaacttgcttgtaggtgacttcctatttcctggaaggacaggtggccacactgccgagcagagggcagtttggattgtgacaccagaaatgcaaagagaaaacagacaagttagcgttttcgtttttcttccaaaataggtttccgaagcttatcccctccatcaatacttttgaaaggtaaaacaacttcctttgcaaaagctgcattttactggaagcagatgagattcttagaattgacagcagaggcaaggaataaagtttattccaagacctgaatggaaaaagaggaagaactcatagttaagagccccatcagctgaggagggaccgtgagaggggagacccagatggactgtagttttgggacaggggaggaccagagagggttcctgatagcggaacagggtggttgttggggcgtggatggggaaactggggggcagttggcggcgtgcagatgaatagagctgttgttcagagtcagctgcagctggtctccagtgccaggaagtcaagatggagccctcagaacatcagcctaggtggaacaggcactgcgacaggctcacttggggaagcctcgttttctcctatgcttatggctatctggaaggccatccacgggtatggcagtgatctggatctaccagtccgtggatcaccagagcaaacatctgccacctgcacctcagtctggactctttcttccaggaggttaacatactcacaggcctgttgaaatcctagagggatcagtggtgatgtggagggaacaccctcacccagcccacgcctcagcactggaactatatgtgggtcaggtcagtggtggaaactcagccctggcctccacagccacctctctgctggctccgggagtgaagagtagaaagactgggagtggggagagggatgggtgtctgcataagggtgaacgaggctgacaccaatgcagtgggaacattggtgaggccaccttcttgaaaaacacttcaggtttgtagtttaccaattttgtgaattttatcttgaatattttaaaacctaagtagtttctcctgctatctgtgcaatatgaaatagctttttcattggcatggggatttgaaaaacatagtctaagcaaaacataattagaaagataaacatagttccttcttaatcatatgacgtacatgaaagcctaaatagagctgtttggtacattttgctcttcagtattatctgcgtcacagctacctgctcccacccttccctgtgagatccattacagcagataatgacgagctggctagatacagggaagagtaaaattaagccttgatgtaaccagtgagagctacactaattcctgcccactcagcagttgatgctctgataggccctttatgtgggtggttgttgggcaggttttagaaatgcagtcacaattaattgctgtgaacctaggcaactattcagcctaagaagacatcaatgatgtcttcttcttcttctgtccctctatctttccatcatggggatctgacattacattagaatgcttgggtgatgggaggtttggtctctgagctcatccaaatggctcactggtggcactaatgggacctctcctgttgcatggaggatctgcaagtcttcactacaggaaagcaactgaccacgtctgctcacctgatagtagtttggttacatttacaatagctgccttatgtgagacaccgttctctccccatttgtgtaaagtatgcagaaagtttccttgggtattttattttttagtgcaagagttggagaaagcatgagtaaaagttcttgctacacacctaagtatttcataatgttatttattttaatttaatttttttttagagtcaaggtgtcgttttgtcactcaggctgagtgcaataacgtgatcacagctcattgcagcctcgacctcttgggctcaaacaatcttcccgcctcatcctcctgagtagctaggaccgcagtcatgtgccaacatgcccagttaattgaacgtttttttagtgggccgggcgcagtggctcatgcctgtaatcccagcactttgggaggctgaggcgtgcagattgcctgaggtcaggagttcaagaccagtctggccaagatgatgaaaccccgcctctacttaaaatacaaaaaaattagccaagcatggtggcgtgcgcctgtaatcccagctactcaggaggctgaggcagaggaattgctttaacaagggaggtggaggtagcagtgagctgagatcgcgccactgcactccagcctgggtgacacagtgagactccatctcaaaaaaaaaaaaaattctgtagacatgggatctcactatgttgcccaggctggtctgtaactcatcaagtgatcttcctaccttggcctcccaaaactctggggttacaggtgtgttcctagctcaatctctccctccctcccttccttctttctctctctctctttccctttctttctcccttccttccttccttccttccctccctccctccctctctctctttctttctttcctctctctctctttctttttaaaaagtttttcagcacatgtaagccctttaaactacacttttctccaaactgatttatgtacaaaagcatgctatagtccatcaacaacaatgacagggctgtgtcactatcaataggcctacatttaaaattattttctaggattggaaatgaatgcatgttgattccacccatgtttcctgccagaccctgtttgctgcaaagcttccattaggaggtcacttggttgagaataggaggacagttgctggagacttgagaatagagaagagcttaatgtacattcacaaaatattttgccacaattttttgtccggttgataatagtttcattaaaagtatgcaagacatatagtttttattcacttaataacaagtataatgaaacatctgaaacaacctgaatgttcaataataaacaactgcttaaataaattatgatacatcaacttagctgaatattatgcaactattacaaggaaattatgaacttacacaaaaacattaaaaatgctttaatattggaaaagaataaaaaattatatcatgctgtgattagacaagaaaacatatgttcattgaaaaagacaaactaatttatttatcaaggttgcagaataatggttaatttttttctttaaagtatttccattgtgtgttgtcccctgatatcaggtgctgagaaggatacaatatcacttctgttagtgtccctgccaaaaacgcatgaactgaatctaatcatgaataaaaactaatcatgaggaaaggccttctacagaataatttgtgtgcttcaaaaatatcaaagcctgtagaaggccatgaataaaaacaaatcatgaggaaacatcagaggcacccaggataattcgtgtgcttcaaaaatatcaaaaatatcaaagccatgattgaaattttagcctatgttcacttataacaaatcattcatgtagaaaataattcagtaaataatcagacattttatttttatagtaaaatatcattttccaaatataaatgtcagtgaaataaataaaaagctttaaatacaaatgaatattttattgattatttttattttaaaacttttactttaaactttgttaacaattttattacactttttcatttctgtttgtgatattttatgattgaaatttcctgaattaagttgatctgtgttatcttatatttgtcagaaagtttaataatctttaatgtctctgttattattccaggaaaagatagaattgtaatagtctgacaatgacaagtaattgcttagactatttcttttttcttggcttagggatactaaatttgtaatatattaagcttaccatcacaataagaaatattcttctttctgactaaaacaaccagaatttaatatttttgtattacttgatgagaaaaatccatttgcagttgagctaaaaacaaaagaaaacaaacaacagcaataagaaaaacaaaggaaacactgtgttgtttttctgttccacggaggtgaaagagaacaagactcattatactctcacttttcctagattgaaaatttctcttaaaattgggtttgggatctaattccataattcttttttttttttttttgtcttatagtaaagaatatagctgccatttttattttgcaggtgacaaccgaaccttaaactatttctaccaatgctaccagtaaatctaatgagttagcattagcttttcataaagtcataactttgctctggtgaatacattttcagttgaactgtactcaagaaaaattccatcccagcactttacttaaaagattgtttaatgttttgttttgtttttggattagctgtaattgcagaaaagaagtcctcagagcgcagagtgaaagtctttacagctgcgattgtctccccagtggtaatgacaggtttaatttaaaactgcatcctcttctcactcagatcatcttaagaccaacgactcagaattgctctttagagttaggagttggccatggtatcaagtgccgataacgtggtctccacaggaattcagattctgatttgggcctcgctgtgttctaatcaaggaacctaatgaactacactcatggtaagttcatctagtcggaagccttggactgttcccagactcagagtcaaatgttttaagtggtaatcaagtttcccttgttattgctcatatttaatcatcagaaaattctgtgtatttatgtcgatatttaaagaagaatctttgattccatgtgcatgctaaatgcgaattggctgtatagagttatgccgtttgaccttcttcaacacacggtgcggagtgcaacacttccctgcagtgcttctcttctgtgactttttttttaacacttaaatttgcatttttgttcaaggtgatgtgaagaagttcaatgctactagcacatacaattgattcagtactttaagagataaaaattattttgatcagtctattcaacaacaatttattaagaagctattttgtgccaagcactgtgccagatactaaaaaatagtgaacgtggaaatggaaaaaagaagaagattgaaactgatctaatagtcctaccaacagttgctttttagatgaacatagaaattaaccctcctggtcttaaagtttgaaacttacatgttttatctgagtttcttcctcaggaaaggatccccagggctctcaaaaaaaaagtgtcaaagaactgaaactcaccagatcatgacatccagacaaagagatgccggacccctcatccaccatgattacttccttacccctcctgcgtttctgttttctcacacattgctacatttttctccctgctatataaatctcctaattttagcccatcagggagatggatttgagactgagctcctgtctcctgggctgcagcacctggttaaagccttcttccttggcaatacttgttgtttcagtgattggctttctgtgcaatgagcagcaggacctagactgaacccctggtgtttcagtaacaagattgctgaggaaaaagaaatgatattatacacaacgtatatgtttattgattgatcttgtttataagttgtagatctgataaatctgaactataaaaatagggaatcaataaatagattcatacatttattggttttattagttgacacttgacaataaagtatggaattttcctcctcttttttggttcatcaaggctattctataaggtgggttgaaactccaagaaggttcaaaataatccttcccttacacccctacaagaaacttcagttcatgaacttaacaccagtatgtatatttttccagagggttgggaatgatcttgatagagatcaatagaaaaggaaattgtggacttattgggaatagaaataggaagtatagcagatttcaaaatagaaattgaagtttttgcattaaggacttgtaagagattgctacaagcaaaacagacaaaaatcccagctcttaaagttttcacatttatggttatagattacaaactgtctttgcaatgagacagggtgtggttttgcaaactggcagctatgcaacaatataatggaaaaataatgcaaaacttttgcagggtaaaaaggtgactactataaaggatgcaatatttcatgaaatcaataaaagtaatattaaagaactgcacatttcaaaacaaactcagtgacaaatggaagtttatcagtctagaccagctaataactgaagaaaagagaaaaaaaacagcactgatgaataatagctaagttaaatagaatggctccaccaccaaagaattcagaaagatcatggaaaattgttgaaaccttgacattctttacaaaaatttacaaatgttatttaaaatatcaaacataaagtaagaaattctatacctgtatactatcagaaaaaaatatatgcccaattcaacccctaacatcttattaatttttttccttaggatgaatcacaattataaccttattattattaaaagtaaaataaacttattttataacgtacgttttattgagaaaatcttaggaaagcctctcccatcccttaccccattatttactgtgaacctctattcagtggctttatcaagagccactgatcaaggaccttttttatctctatgcgaacagccttcttagccttccaattttgaggtccattcaagtcaagcaattcacttttgttttggttcagcagttggagaattgctgtatttccgatcatcatattcatcccactggattgtaaggatatctttcatgtttagtattctctaagtcagagaaattttaaaatttagatccccaaaatgatagtctgctccactgatcacatgtatctatgtattagttttctattgctgcataaaaaaatgaacacaaacttagcaacttaaaacacatatttagtatcttaccatttccaggggtcagaatctgggtgcggctggtctgggtcacctgctcagagtttcaaggggtttctcaggtttcaccatcatctggaggattaactggagaagaatctgctctcaagttccttcagggacttggcaggattcattgtcttcaggtagtatgcctgaagactttcggcttttcactggagtctgctggaggctgccctcaggccctagacatcaccggcagttcctacccactcaggcttctccaacactggcctttactttcccaggcccacaacagtgaatgttagtcctgttgctaagctacagtcttccagaacataatcaaagaagtggcttccatcacctttgtcatcatctatcggttagaagcaagtcacaggtcttgcccacactcagtgagagggattacatgaatgtgtgaccaccaggagatggtaacaattggggtcatgaggggatatgactgctacaatctcccatcatcaaaaacaaaaacaggaatctgtaagttgaagttcaaggttatgaaaagcaaactggctttctgtttttatcatttctggatatacagaacaattatatcaaatttattaatatgaactgcatcatacttaagttttaaacattagtagtattctatttgaaatttttttcctgtcctacttaaatttttgaggacattttatatgtttaggaatgatctaaaattgtggaatgtcacttttttctaaatcttcaaataattctaaaccaaatggaatacagatgaacattttctagaaatcactgacattcactattttaatttcttagccattgataatgtttttgaagttaacatttactctggtcacagtggctcatgcctgtaatcccagggctttgggaggcttggtagcagaattgcttgaagctaggagtttgagagcagcctggacaacataggattaccctgtctctacaaaaaaatttaaaaagctgggcatggtgatgcatgcctgtagtctctgctactcaggagtctgaggcaggaaaatcacttgagcctaggagttaaagacttaaaggaaacagtgagctctgactgcactacagcactccagcctggacaacacagtgagaccccctctccccgctctctaagcatatatatatatatatatgtgtgtgtgtgtgtgtatatatatattattaaataagtttatggactttataaaatttatgttaaagtgacaagtatatagtgtgtgcagttacaggcatgaagaagcagttaataaattatcctggaattaaaacttgaagagcattctgaattacctatttatcttgaattgtcttagatcaaagcaagagcaccagtgaagaatctatttggctgatatggaccctgttcttgctggttaatgatgagcatcactgttcagctagaacacttgtatgatcattacatggctgactccctgtggaaatgggaagggaataaggaatacatatttggaatgaagaacagtttacaaacacttgtttgttggtactaatttacagagaatagtgcaagagttagctttattttttctttattaatattatgtatgtataactttatatatgttatatgtgtatcttacatatacatttctagagaccttaggaatagaaatctgaagagctgagttgcaaaccccttattttcaagggtcgaacacttcaggtagttggtgaataatttattacaaagaatctctacttagaattgtaacgtgtgtgtatatatattatatgtaattatacatatgtaatatatacatacaaaaagacagagacagagagagacagagaatttacgcaccaaccaacacaaatacatatggaataatagaacatatgttaatatccctaaaattcagtatgtatgaggccagaagagagcgttcataaaatataaaggataaacattatgtatacgatgttttctcactgcagtgaattaaaattagataccattagcaaaagaatggattataacaaaataatggattctacattgagatctttgtcgtcaaccattctctcattacttctgtctcaacgagtgaagctctaggtacagaatgttctacaagttagcgtttccaaaatttcaggaaacacacaatctgtgtcttacataagttgtttcagaacacataaaaggactaaaaactgcctaactccttttatgagactactgtgatatttttaaagttaagcatcacggaaaaaaaaaagaaaatggtaagtaaattttatttctaaacaagttgcaaatttctaaaatacaattgtacatagttgaatccaacatagtagcaaagaaatgagtttaataggatcaagcctgatatatcccttaaatgtagaaatttccatagtttaaagaaaactctacaaagtaaatcaccatattaatgagtttaggagaaaaattccatgattatttgagtagatatttaaccacactattaaaacattttcactgcagcagtcattggtgtaaggctttacaaatattaactcctttaatcttcataatagccatatgtggtaggtaatattacccacattttaaagatgagaaaactgaagcactgggagattatgtaattaggtcaattaaggtcattcagctaatatgcagaaaagctaagatttagtacatgcaatctagctccagcgtccaggttttcaaccagtcttttatgctgcctcttttgcaatatatggagaagaatcatttgataaagttaaacttttatttattataggcatggtagaacacttggaccagaaaaaaaacctttaacatcataaaagctatgtttactaaaagtattcatgttttagaggcattccctttaatctcaggaataagaaaagaataccccctttcattttcctgtccaatatttgttcattcagcaaatatttgctggtcgtctactgttggaggccgaaagaatgagggtcttgatcaactcagtataccaccggaggctatatgagcaaacagggaactgttctcatgaaagcaggatgttggcaaactgacaaactgcactggccacccagaaggaatgctaagggcagtcagacccaggcacaagtgtttcttgtgaataggcacatctgaagcctgttagcaataatatgaaccatgatcaatcaagcagctgatcaatcgttagctccttcttgctctttctacccaaaaaatatgaagggcaggagaagcagcggtggctgcctttgctcactagaagcagggagccctcctcttcttcccctggcctcttctttaaaacagtttcttttgtcttaagttttcatttctgcgttcgtcctcctttgttcagttctgtgatgatggtctcaagtagtaacagtagtaactgtcatagtgacaggctcaagtagtaaccgtggcagtctgccacaatctactatgtgccagacactctcttaggtactgggaatgcagctgtgaagaaaatagaccaaaaaattctaccctcatagagcttacattctagtagaagaaataggtaattagtaaaataattatataagttatattggtaggtaatatgtgctatgaagaaaaaataaaacaaaaataggaatagtgggtactgggaaaagttacaattttaaataaattggtcagaaagtaatccttgaatgaatacttgaaaggggtaacgtgatactgaaggttctagccaatgcagataggagtgaagagataaaacatcattgttagaagatgctctgatcatttaatagaaaattcaagaagatctacccaaaaaattattcatggcattacaaattcctcaggtttccaagaaataaatcaacataaaaatccattccatcatttacattaaaaacagtaaattaaatataatagtatactaataccatttaattaaataccttagatttagcttaacagataaaatgcatttttatgcattttagcttttgcttcataaatatgtttttaaaactcaatttaaaaactttaaagaaaaccaaaacaagtggaaagaaacatcattatatgtcagttccctccaactcaattcaatatttctgataaaaactctagctagattttactggaaaaattgaaaaactgaatctaaaaaaatacagtgaggaacaattgtcaacacttagctaagatgactttgaaaaagaagccccaatctattgtattaagacatattacaaaagtatattaattaaaagggcatggtaatagcatagaaacagatgaatagacaaatcagaaataaaaacatgttcactatacccttttatatataaagatttgaaatatggtcgacctggcatcaagaaatcagtggtacaagagactgagataggaggataacttgagcacagatgttagagaccagcctgggcaatatagtgagaactcacttaaaaaaaatcaatggtaaagaatatatttattaaatactgttaaaaaattggctcattatgtggaaaaaaagactttgattcctacctcacatcatattaaaaaaataaactccagatagtctatagatctaaatgttaaaagcaaatatataacactatgagagaaaatataggaacagatccttgtgatgcagtgtgtgggaaatggtacatatttatgaaatactcctaacaaatattttattacatcaaaattatgaatttgttttaaataagagaaactgccaggaacagtgaggagtctgagattttattctacttgcacactgacaagttaaagtaccatagttttatggatgctatgagaagatacgagactcttgggtcagagacaaagaattctattactcatggcccagcaggcagcatgagcttcatgttcagctggtttctcatagcccccaaggtccactggagcaatgaagatggtcctagatagatgctccactaacagtgggttgacataacagcaagaaaacctcaagttcaggaaaccccaatatttttaaaaaggcttcaaataaacttgcccaacttttgtcacagaaggagatattatctttattagactggacattaaatatgccctctaatccagatgaaggcagtgtctctgtcatccaaggctgtttactatacacacatccttgaaaagatggtacagcacaaaaactgtcaatgtctttgcttgcaaaaagtgcagaaatatgacagacccctggtgaattgtctgctaagagaacaaatagtcaaagtaaacacaaaggttataggcttagatattttgctttagatttttctgactttcaagaaaaagataggaaatcaattaaaaatggatagtagttataatcaactcacataagattcaactaaaaatgtgaatacatgtttaaaaaattgttcaacataagtggtaatctgataaatggaaattaaaactaatataaaacatcaatatatacccatcaaattgaccaaggtataaatcagttaatatcacatgttagcaggaatacatagacagtaaccttcatatcctaccagtaagagtgtatctgagaccaccattttgagagcaaatttggcatattggtgaaaacattatgcatatgccttatacccaataatttcatttctgggagtaaaccccagaacgactttgctcagagatgtgtgaagacgttcaattcggcagtagctggaggctatcttcatagaagatagccatagaaagtggaaatggctgtgcaaattatggtttatctataagatggctgtcattcattagaagaaataaacaatacctagaaatactaaaatataaatatgtcagagtctaatattcagtaaaaatgtaaaactaactgatatttatgtagatgtttaaaaaacacacaaaataacccaataatatacaaaatcacattcacttccctataaccattctctatttcctttcccttcctttgctttctctttctttctcctttcctttcctctttcccctttttcttttcctttcttctttcccctttcctttttttccacagggtcttgctctgtcatctaggttggagtacagtggtgcaatttcagctcactgcaacctcgagcttctgagctcaagtcatcctgccatttcagcctcccaaggagctgggactacaagtgcaagccatcatgtccagctacattttttgtacttttgtagagacagggtctcattatgttgcccagggtggttttgaactcctgggctcaaaggatttgcctgccttcagcctcccatagtgctgagatcacagatatgagccatcaagccaggcatcctttttctttatagccctgatcaccccctgaagttacattacgtttatttattaacttgtttatcattcgtctccgccagttggtggaagccaatagggcactcttgactgtcttggcagtcttttccctggtggatcccagctcctacaatagtgtctgacccataatatgagctcataaattatttttattgaattatttatttttattgatattcatctgtaaataaatgaatagaaacaaaaagtcctatgtaatttgtgtgtcttcaggcctccatggcctctgacattaagtaacatcacgtaacatcattaaccactttttttttttttttttttgagacagggtctcactctgtcacccaggctggagtgcattggtgcaagctcggctcactgcaacctcctcctcccgggttcaagagagtctcctttctcatctcctgagaagtggggatcacaggaacgcaccatcacacctggctaatttttgtgtttttactagtattggccaggctggtcttgaactcctgacctcaggtgatccacctgccttggcctcccaaagtgctgggattacaggcctgagcaatcgcacccagccattaaccacagtttttgtaagtgctttcagctggttttgcaggactcctggctccctgaaaaatccacttaagtacttctgagagtccttataagggggcgtttccctttgtgaagaatccctacaccgaatctatcttcttcttttcctgatagggctgctcctccttgctgtcttttgctcatgaagctgcctaaagggtgactcagcactatgcaacttccaggtaccaactatgagatgccaaagtccatccaaaggatggacccaaggctactggatcttaaggtttcagacaagtgtgtgagactttgtacatgaagttggagaatgcctcactctctaccctgtacagggttgtgatccagagctggatttcagacccctgtttctacaggaactctaaacaagcccaggtaaaagacacaccacatccatttctccaattaaacaaacagcaaacaaagatacaactttatcctcttttcttttctttttcccctccctccctcccttccttccttttctctctctctctcttcctgttttttttagaaagggtctcactctgtcaccgaggctagagtgcagtggcgcaatctcagctaactgcaacctccacctcctgggttcaagcaattctcctgcctcagcctcccgagtagctgaaattacaggcgcccatcaccatgcccagctaattttttgtatttttagtagagacggggtttcatcgtggtagccaggatggtctcaatctcctgacctcgtgatccacccgcctcagcctccaaaagccctgggattacaggtgtgagcaaccgcacccggactatcctttttctttaatcaaacagcaaaatgtcttcctatcagtttttgtaaaaatttctagaaatgtcattggccaactagcttcactaacactcaagctctgaattgcagctaggttagctcttcttgatatatttacatccaaaaggaggaaagagcttcaaagagggtgtggccaaccccgtacaaataaggagaataggtctgagaagaggccattgaatttggcacctagtaacttgtttgtagtagtaaaggagtttctgtagtcacctggagtctgacttaaaagcactcaaaggattttggatgttctgtaggtcgactgggctccactaaacatttggcaacagacaagcatttctctccaagacattgagaaatacagagcaattctctttattttctttagagatggagacatgctcctgtagccaaagcaaaatttggagccattttgcttcctggtccctgggcgtaggtttgctcttttgtttaataagagagtcaacagtgctttttacaatcagtggtttctccagcatcctgactaatattatctcccttcacaaaataggctttggcagcccaggctgtggtaaacaattcctgagagtgcagtcactgtggtcactctggccccctccgctctcgccatcttctaaacccaagctgtaaacattctggaacaagggctccataaactcaagctattttgttccttcagagaacaagtcacaataaaaagaggtttataaaggcgtcgtttttttgccaagagagttgaatgaattcttttatctcctcatgattcattcctaattgcaagatttttatttttagaaagcattttggaggtttttgttatgtagtggtaaaaacacaaaatgatgcactcagcattccagatcacaggctggagaggaggaggagttctgtggatgtggctctcgccatgcaaggagcctgtggtcttggtcagcctgggctgctgtaacaaaacgttgtcgactgcggctctgaaccacaggcatgaccttctcacagttctgggagttgggatgctgaggtcaggctgccaggctgttgggcgcttggtgagggccctcttcctggttatgtccttacctggtctttttgagtggcgcatggagaaagaaagagatcctgggtctcctctgctttttataagggcacacactgatcccatcacgagcaccccagatcctgggtctcctccactttttataagggcgcacactgatcccatcatgagcaccccagattctgggtctcctccactttttataagggcacacactgatcccatcacgaagacctcaccttcataacttcatctaacccaaatcccctcccaaatgccccacttccaaataccatcacattgagagttagcatgtcaatatatgacttttgggaggacacactcatttagttcatagcacctgtaatcagtgaatacaagaatcgttgatctctgtagcggaagaggattttctcgttgcctgactgctcttgaaaacagtcctcctggagagaagagtggagtgcaggaggtgatgacattttcattccatatgtgaaacaataaatgcctgatagtgagagttttcagaaggatgaacaggctgtttgtaagaatactgagttctatgtgactggtggtatctaagcaggggttgggtaattgtggaaaaactttaagagcattcagaagggcccagagaagtggctcgtgtctgtaatcccagcactttgggaggccaaagtgggaggatcgcttgaggccaggagtttgagaccagcctggtcaacttaatgagaccctatctctacaaaaaattacaaaattgggtgggcgtgatggtgtgcacctatagtcccagctactcaggagtctgaggtgagagaatctcttgagcccaagagttcaaggctgcaatgagctgtgatcgtgctactgccctccagcatgggaaacagaacaagactctgtctaaaaaaaatgtgtatgtagatatatggcagtccgagcacccaggtccccagttctcctttcagtgctgaagctatgtgtttgaaaatttacttgggggccacagctgcatacaccctcatcacttctgcacaattctcagtcctcaggaggcaatagtttagacttaaacttcaacgtaagcagactacattggagaaggacaaagggaagctttccttggttccataggacattgtcaaggagtcaggggcaggactggaatgaacagtatgagaaatgaagtatgcacaatcgtgcgtgaacattatgggaaacatgacaaagatgcgatgattttgcagtccccaagttccctgcgtgtaaaatcaagtgtcacaagcaaagcagaatacttgtcagttcttttcagtgataatgttgacaccattcctcctggtttgagttcctttcttcccatgctctctctacccacagaaattcagccagttttcctgtcccaaatcaaataggactttccccataaaataattccctgattcataaaatacaatgactataataattatctgattcctgctatccacatgtcttttgatctattctgtttagcactcttatatctcttaggttattctttactctaaaaataccttttcttacatactagagtctaattttttgaggacagacattgtgtcttttttagacttttatatccctaagatgtcaaataccctaccttatggctagtacatctcagtagatagatattaggtggccgggtgaatgagcagaacattctaaatggggagaaacggcaaagctaccttgctgctgcaggattctgctccctttttccttagatctaactatgtggtcttttatttcagacactcggctgggaagtgagagactcaaaacaacgtgagaagtagaaagcgggcaagtttgttggggccatatgtaacttcatgaatatcactgtttcaaggactaagttataagttttacccttttcagataaggaaaacagagtgtgagtggggttagaaagaggaaaaacagcaagccaagttgaatcactcatcctgagaggcattcaaatacagagttatggagaaagcgactttcctccacaagggtaaacccctcaacagcagctggtaaacctcagtccacagcgcagagtgtgagaaagggaagatttcaaacaacttaaatacaaagaaaacacttttttaaaacattagtgattcttttccacatttccctttaggctctattcatacggaaaatattccgctacacctcacagcaatatatcttattttttttaatatgcagcaaccgtcagccaactcatagctgaagcagggacactgtgcagctcttggagcttgttcttagtatgtgttcagagggctaatactctgtcaagcagggcggatgatagccagagcaaacagccacggtccccacggtggaaaataacgttgccaggcaagccaaaatatgattttttctatgaattttctttccagggagtacctctgaaaaacacctctctagcataacagtcactgaattaagttatatatttttagacaccactaactgttctttgttttttcttccatttctagaaaattccgcacatctggaaagaacagcaatgaacaggaacttgtgcattcgtgctaggctcctactgggcccgcttcgtttcatttcctccatttttatgacactttcccatgctgctactccagacattccatcaaacacctcgccacgaacaaattgaaagggaaggaaatctaaagaaagtctgactgaatttctgagtgtctcatcactagaatgaccaggaaaacctgccaggagtgtagattcaggcccctaatcccacttctctgcagtctcctcttggtctctgtgtataagctctcctgcctttttgcacctctaatccattgtcagacaaactggcctacttgtgtttgcctctgagagcctgtccacttcctcacgttaggagaaagaacacaaagaatcctagctttgattcagttttccatacttcagccatcagtctaccatcaagcacattttttactgggcaaatgaaaagtcattgctttcaattttttttttttttttttagactgaatctcacctgtcacccaggctggagtgcagtggcacaatctcggctcactgcaacctctgcctcccaggttctagcaattctcctgcctcagcctcccaagtggctgggattgcaggtgcccaccaccatgtccagctaatttttttgtattttgagtagagacggggtttcaccatgttgactaggctggttttaaactcctgacctcaaatgatccacccacctcagcctcccaaagtactaggataataggtgtgagccacagcaccccgccaatatttttgtttctaataaaacaagaactagtagtgcactccgtctagagcaagatagtgtggtggggacagggagcaagtaggtaggggataaataggtcaagaactgaattcacaattgaggctttaagcttgataagaaataaagcaagtttgaatcatctgggtccctggggaagcatttgtttagaaaaagatcaatagtaaataaaaataccacgcacctagtttccaggtattgatttatctaaaagggacctggctttcacatatttacgatatgcaagtgcatttcaaagctttgcctgacagctggatgcaagctgggtgaggctgtaggggtgacagtgtcatcacatgtgagagaggctgtgggggtgcaggtgtcatcacatgtgagagaggctgtgggggtgacagtgtcatcacatgtgagagaggctgtgggggtgacagtgtcatcatatgtgagaggctgtgggggtgacagtgtcatcacatgtgagagaggctgtgggggtgacagtgtcatcacatgtgagagaggctgtgggggtgacagtgtcatcacatgtgagagaggctgtgggggtgacagtgtcatcacatgtgagagaggctgtgggggtgacagtgtcatcacatgtgtgagaggctgtgggggttcaggtgtcatcacatgtgagagaggctgtgggggtgacagtgtcatcacatgtgagagaggctgtgggggtgacagtgtcatcacatgtgagagaggctgtgggggttcaggtgccaccacatgggagacaggctgtgggggtgacagtgtcatcacatgtgagagaggctgtgggggtgacagtgtcatcacatgtgagagaggctgtgggggtgacagtgtcatcacatgtgtgagaggctgtgggggttcaggtgtcatcacatgtgagagaggctgtgggggtgacagtgtcatcacatgtgagagaggctgtgggggttcaggtgccaccacatgggagacaggctgtgggggtgctgggtaccaccacatgtgagaatacagaaaacacaaagccgtcagctacggagaattaaaatcaaattcgcatagctctgtactctttcaggggatgattcttggcctattttaaatattctgaattaactttttcatttcctacattttttccctgacacaagcacattcccttagaaagagaagaatcataccgtatctctatggagataaatatattccttggtttaaaacaaaatcctttctttcttccttatttccttcatttcctttctctcccccttcctccttctcctcctctccatctctttctttctttcttttttttttttttttctgagatggagtcttgctctgtcgcccaggctagagtgcagtggcaccatattggctcactgcaacctccgcctcccaagtttgagcgattctcctgcctcagcctcagagtagctgggattacaggcacctgccaccgtgcccggctaatttttgtatttttagtagacatagggtttcaccattttggccaggctggtctcgaactcctgaccttgtgatccacccacctcggcctcctacagcgctgagattgcaggcgtgagccaccgcgcccggcctccatccctttcttattattattttagctgagcagccctcaggcgagggtgtcatctgcgcagcgggaggcagagtctgagttaggtgcatggtggagtcacactgccagccgctgtggaccgtgggaacgatgcctggcagggtaagggtggcaggggtgcagcgtgggctgttggtgattgggagaggaaagacggcatccacaaagggtgtgacggggtgatgcccacggagggtgctgagggagatgatggctttgacaggcgttgagtacctttattggtactctggtgccgagaatcaccaatatggaaaaggagaaaactgggatgaacccgttaatgttggactggaaatggaaatatcgtgtggatttcaatagagagataaacagatactataattacatgcaatataattcatctgtttcctagttctgtcctctgagagtcagagagaagtgacacctcaagagcagtcggcacatcttttccgtggtctgtaaatgccattctccactgagaggactcatggctccttggagagctcgctgaatcctgagctggggaacggaaggtacagatgggccagaaacacctttttgtatgggaagataagaaaatggtcccgaaattataaaactatgttgagaagacattgtcaaatctgggatcatttgattgtcaaataagtaatgacagtgacagattataaccagttgaataagatgggaatccatgagtctatgcagatatgaatgaatgaatgagagaggtaaaatattttccttttatctctgatttaagcaattcagcaaaaacatcaaggcatgtaaaacatgtgggtgaaagttagatgaggtacaaactacttggatagtctcaaggtacctctgcacaaaatacttccaattccaaaggtagaagagaatagatttactatgagggaacctggaagatatgaccttaatccagtgctcatgtttaatatcaccagtaatgggacaaagtgcatttgtttgcaacctgaggggacacaatgaggaaaacatggaatcactgctctgatatttctgctcaaaatgctcaacttgcatctggacatgaagaaaaatcacataaacctaaataggaggacacagtacaaaatacctagcctctaattttcaaaagtttcaagtttacacaccagtcaggtaaagagggagaaggcatgaatccagcctgagggtaactaaacagacatgacaactgtattagtccgattgtacatggctataaaaaactccctgagactgggtgatttataaagaaaagaggttgaattgactcacagttctgcatggctggggaggcctcaagagacttacaatcatggcggagggggaaggggaagcagatgccttcatcacatgacagcaggaaagagagagtgagggaggatctgccacacttttaaagcttcagatctcatgagaactccctcctatcacgagaacagcatgagggaaactgccccatgatccaaacatctcccgccaggtcctgacacaaagggattacaatttgagatgagatttggatggggacacagccaaaccatatcaacaactgaatattaatataactggattctttctattggaaaaatggtgaagcttgaatcaactatatggattagatggtagtaatatacccatttgacttcctgattttggtggttatattatggttatgtagaacgatgtcctcatttattagaaatttatactaacatatttgggaggtgatggggcataaggttgcaacttaatttaaaatgattttaaaaagaaagaacttcttgtactattattttaaattttgtaagtttaaaattattttaaaataaaaatgtgaatacatacacaaagaagtgcaaacaaaatcggaaatttgaacaagatctgtgggttgtatgaatttcacatcctagctataatagtgtactattgttttgcaaaatgttactattgaggaaaattggttaaaggtataacaaaacttgtgtatcatttcatgcaattgcatgtgaatctataattagttcaaaaagattttaattatagaaaatagttttaaaatgttcgatttgagggaactagcattgaacgagcaaagcttttcagtgaatcatcataacagttctatgacatttcacattattttattcaatacacagactaagaacataaagggagagaatttaagaaatatgcttaagacttgattgttattaactagaatgaatgaaattagattaaaaatgtctgggtctacagatagaataaaatattccaaatatactcaattaccattactgatgaaactaataaatgcataatttttgtcaaataaagtagatctaaatttttttaaaaaaaataggtacttagttctctgtgcaggttatgagggtaaataatttttattactaagattccacagaacctaaatttcaatatgaacctgaaaataatattttcgtaattcacctacaaacagacccaacctctaaaagttcataaggaatgactttggtattttcttggcagaaattgcaattttataaatcaaacagttagcagttgacatgaaaatacttaagaaaaatatagaaacagaaataagacgtgagaatagatgtactgattacctaagtaggagattctgtcctctaaaattagctcacttttagtgttggacacatgtgataggctgagggaaaatagattcttctttaagaacatggaacatcattaggcaaattaagttattgctggttatctgctctctgaaaaaaaaaaaggcccctattctaacactggaactccagatgcagctcatggaatcagcatgtgttgaactaaacgtagagcacatgacaggtgagagctgctgggagacgtagggaatggccacgcgtgggagcaaacaatgagaccaattcctctttggcaataataaacagtcttgtttgtctgagacgcagtctcactctgtcacccaggctggagtgcagtggcgcgacctcggctcactgcaacctccgcctcccaggttcaagcgattcttgagcctcagcctcccaagtagctgggactacaggcgcgcaccaggatgcccagctaagatttttgtatttttagtaaaggcaggatttcaccatgttggccaggctggtctggaactcctgatctcaagtgatccgcccacctcggcctcccaaagtgctgggtttacaggcatgagccaccgcgcccggccaataaacagagtcttaaaaatgtaaattcaaaatcatagggaacatatttccgacttatctctggccgcagtaaagaaaacaacggagatggaaaagctcaagaatgcagtcagctttctccatccaccctgacatacagtgtgaaatatgactgactgaagctccgctttcaagataaaggatgatcgtcacaacggctagtatttgtgggcttcccgtagttgtctagagttaccaagtggcaagtggctgccgcgagatgaacgcggagtagcttggccgtaaagaccatgttctcggtaattaattagtcctttgtgagcagttcagtacaactttgaaatgtatttacaaacttcagaagttataacagatttttggaaaggacactattatttaaactgtaaacggatcttgctggaaatctataaagacagtttggatgtatttacactgacatttaaaaaatatcttttttttttttaaccaaaggaaattctttattgtaaataagatataaagtacaacaaaagaactattgtgcaaattgtaagtcataaggatttttttaattaaaacttttgttttctaaggatccaagttttgatgtcagaaatctacacccaatatacaaaaacaatgttaaatgggaagatatagtgacatttttcattacatattttaagcaatttacttttgttttgccactgtgtatatcatccactatataacagaataaaagagaaatactgttaacaaaagcaaatgttctaataataatttttctacccaactacctccacattcccaaaaaactcctacaaattaacaggacaacatttgtaatttaattgctttgaagcatagctacgatttgtttttgcatttttgttttgaaagtttaacaaatgactgtatctaggcatttcattagcttagaactttagtttgcctgcagtttcttgtgcagatttgaaaactgtataccagtgtgttttctgtagactctaagatacactgcactttgtttagaaaaaaaatctgaagatgaaatatatattgtaaagaagggatattaagaatcttagataacttcttgaaaaagatggcttatgtcatcagtaaagtacttttatgttatgaggatataatgtgtgctttattgaattacaaaattagtgaccattaaaaaatatctttgtgtactttgctggctacatctcaaggacttttttaaatcttttgggaattatagttcaaatttccatatttttctaccaagtgtaaggatatagctgggctattctcatattaacatccagacctcctaaaagcatgattaactgagagatttaaaccaatgtcctttttctgctcttttaagacacaaaaaaacttgaaagaactatatttagtgtctactagaatcactatccagtacatttaaataatgcacatttaaatgaataatatataatttagatcaaaatttttttttatgttaagtgtgattaaatacatttcccctaatcttcaattattattcatgttgatttgctccttcttgagtaaagccagctcacaccaaatcattactgggttatccatgattttatggcacttgtcactggctcctcatttgggaattaaggtaccttactcaagtatcaaaaattttacagccctttctctctatcttctgtagacttattatccctctattaagagagacataattaatttctcttagaaactctcagtacaaagtcataacttacattccaagttctaagctttctctccgctttgactaatttttatgttgtaacaaaaactatgcagctgaacaatataatggtctgaaaaaagtgacaatatttttaaaaattttatgcaaatgttatttgcacaagaattttaaagttttcctcttaatgcagtccccaatcagatattccacaaattgatttttaccttcctctcctatttaagaatagaaatgtcttaataaattgaagtatgttaagacactgtgagagtctctttaaaattgttgtgttcaagaaaaggatgggccaggtgtggtggctcacgcctggtatcccagcagtttgggaggccaaggcaggcggatcacttgaggtcaggagttcaagaccagcctggccaacatggtgaaacccatctctactaaaaatacaaaaaagtagccgggcatggtggtgggcgtctgtaatcccagctactcgggaggctgaggcaggagaattgcttgaacccgggaggcggaagttgcagtgagccgagatgacgccacggaactgcagcctgggtgacagagtgagactctgtctcaaaaaagaaaaaaaaaaacggtgaagataaaatacttaggaaaaaaaacttagagatgctgctagactactcactagatattattatacaattattggaaaataattttcagactgacaaatgttgactatattttgccaacgaatccagctgcagggagaatcctgacctgctgacaacatagcttgcaagtttactgcacagtgctccattttagccccgcctccaggaggtgccgggtcttcggcgatgaaattattcaaaaagtatgtctgaaatgattcattcttttcccctttcgtttgcttttgaggccccttttcttagcagagaatttagaaaagtcagattgggatcaggtactgtgatgcaagggcctggtctcttcagttctggtttaggccttaacagaaaggacaagtagaatgcttgaggctttcacagtcaaccagttcaaccaacatttggtgaccagataggatttgagggcagaagcccaaccaggaacaaatagttttatttgttagagtatagcctgcatcccatcctttagaacttaagaataaccaacagctaagtggggaggtgagttaggtatggccgaggcaaggggacagcatccagagaagttagccgggtgttaccccaaatctgggccatagtggacagttttccatgttcagtgtcattagttgttttaataacaattgtcatgattaatgaaaaatccttcattaaggaaatgctgaaatgtgtcttatgatcttattcccctagattttagattgggatctcaggaagacaagaggtcaatattactctgagcaattgccatccacagggaaatggatacacgaaggtgatggggagctgattctgggctcctcaacaccagcaagtaaagataacccttccccgcataacgttaagtctcttctattgataaagagtgtgtcagggaattttaattatctattgcattagatacttatgaaactttgtagaaaaacaaaatacttgtgcacatgaaaagaaaaggtatttgcatcctataaatttctattttaatttttgctagtattcatgtttgtgtattttatacttttaatgtgttgaaacatacatttttattttgacttttgcaattcatggtaatatttatgcttccatctactaacagaattgacaattatatataggattttattataaatattatattattataatattatccatgtagtctgattctgaccaacgatgttgcacttgaccaggttgctctgaagttgaaatgagccagttcatagtgctgtaggcttaggcagcattgtgcgttactgaaatttatttttgaagttttaattgcaaaatgtaataaaaacaaaattgtttttatttttgtttctgtacattttttttcagcatatggcttatgatttctatttccttataggtgagcttttaatttataatgatcatttgctcagcaggagaaggcctgtaactttgtatacttgtatgcacgtgtgtgagatcaagcttttatcagttatattgttatatatcttgtcatttatgtgtgtcctcactatcatttatagaaattattttaattttaatatatataaatattcattggctatttttcctttgatgatgtgtgttcttagtattgcacttgttcccctaccaacccaggctttatttaaacagaattgcctacagctccatggtgccttaagaaagcagtcatatagcaaaagtaaactgagggaacagatcgccccaccaaagttgcaaaaactccttgtgtctctagctgtaatttaccatttttaagggagtattttgccagctgaaaatgagttatttaacccaaaatgtatatccctaacaatgtacacatctccatttgtatctactaatattctggtaattgttttatttttgcttccatcataacatatctttccaaatttacatggcaatatattattttaataattctttttatgatgggataatttcaattgtgtagacatttaaacgcaccatttttaaagtctgagaattgatcatttttcattattatctaaatatttaagattctaagtatgaactaaatctgtacagtgactctatactgtcttaactgggaccattatccactggaaattatccaccagatctatctattgatctattgatctatctatttatctatctcatcatctatctgtcttagccccgggggtaggtttttagcacctagatcagtttttcacagctattctccatgcattcgcttgctttaggtcatgtgaggtgatgatttcagagttgattccgaggttatgaccaacctattggatttgtttccgtggtggagctgcagatgtatgaatttataacaaattctccagttgattcttatacacactaaatgcgaaaactagagctctaggagttttccttttctaggctcatctaagtacaatcaaatataatgtaagttttattacccaagttaaagaacatttaaaaataaccaatatttaaggatgaaatataaattattttttccacatcaatcatatgaaattgttaaatatctctccaagagattttaaagaaaattagttcctctacctgtaaaaatatacaggtgaccattttctagacatgcgttacttgaatttctttaaattactctcttctgaatgaataaaatttactatctattgattggcgaatatttactgttttattaaagtgtaacatacatacatagaaaaactgtccaaagcctaagagcacagttttgtaaatttttacgaattgagcacacctatgcaaccagcacacatatccaggaagacagcactgtcagaactcatccctcctaccagtcactaccatctccccagggagcatttcacctattccgatttataataccacacttctgtggttagcctaaactacaggtttgtttaggctaactttgaacttcacacaattataagcccttcatttctggcttattgtgccccagcattacgtttctgagacccagccatgatgctgcctgttattactttattctcattgctgtatgatattccattttatgaatattccatactttaccaaagatagaaatgcctggatcatagatgacccagctaggagtatgaggatgctggatgctgatggtgtttaacaaccagagtctgagaaaaaagaagaaaaagcactctgatttacagcacttgccaatttctgaggtgcaaatcttttcacctttgccaatttcaagcaaccagtggtgcatctcgcaagctggtcagccagcccagcacccctttggcagatagtaccaagcagacttctcgagcggcttcagccccaccagcagtctgtgacagttctagttgctccacatacttaaagaggatttttactgctgtggattagtttgcttttagcagttctggtagggacgaagtggaattgactgtgatttttaatgggcattcccttgttgaccaatgacattagtcagcatatttatattagcagcatattttaatatattcattggctatttaaatattcattaattggagttcctgttaagtctactatccgtgttttctaagttgtcttttattttggtgtgaatttttaaaatgtaacataaataagtttctctcttattcatcataactcttacacaactggatatctgtttcggaatctcagagtatcaagcctagactttgtgttactaatagagcccactaaatcttttcaacagcaacttccctgatctttaaaagcagattagagcttcaccctccacttagagtggagaaaggtttttaccttctaacgacttctttgtgaagttagaataaaaacattccctgtgccatctgccagaccttggcctgctttgtgcctctgtctgcccccatcacttcttcccggttcctgtcccgaggacctgctgagctcactgtgcctttgcacttactcatttctgtacctggaataatctcccctcggtttgcacttgactctctgcttctcttcactcggtcctcatagaagcctttcctgaccactcctcctttagaaacactctatccaactactgagctttaatcacatcatagcaattactaacatgagaaatggccatatgtatttgtttacatctttattttctgtctcccaccttttaaatacatgatgcaataaagatacttaatctgtcatttcattcctgcatctaatacttaaaacacggccaggtacataattagaattattgaatgaataaattaaatgcttatttgaaaaaattggtttcttcgcaaacttcaactcctagagcattgtacacaattgcaaacatcatttatccccttagccatattttcttaacaaaagattttcccgcactttacaaaagtgtgatttttcatactttctaaaaagttttggctgggcacagtggcttacgcctgtaatcccagcactttgggaggccgaggttggtggatcacaaggtcaggagattgagaccatcctggctaacacggtgaaaccccacctctactaaaaatgcaaaaaattagctaggtgtggtggtacctgcctgtagtaccagctacttgggaggctgaggcgtgagaatcgcttgaacctgggaggtagaggttgcagtgagccaagattgcaccactgcactccagcctgggcgactgagtgagactccatctcaaaagaaaaaaaaagttttattttcttgtggtaagaacacataacataaataagttctaccctgttaacaaattttaagtgtatagcatattattgttgattataaagacagtgttgtgtagctgatctctgaagcttattcatcttgcttaactgattggtaactctattttccctttcccctgccctgacaaccaccattccactgtttgatcctataaatttgactgttcgagatacctcatgtaattggaaccctgcagtattcatctttctgtgactggcttattccatttaacataacgtcctcaaagttcattcatgttgtgacatattgcagaatttactcctttgtaaaggctgactagcattccattgtatgtgtgcaccacattttctctatctattcatttgtggatggacctttagttgtttctacatcttggttattaatagcgctgcaacagacatgagaatgtcaatatctctttggatcctgattttaattctggtaacaaaaacaaaataaacaaatggtactatatcaaactaaaaagcttatgcatagcaaaggaaacaattggcagagtgaaaagacaaccaatggaatgggaaaaaatatttgaaacacatatatctgataaagggtcatctccaatatttagaaggctctcctacaaggcaatagaaaaagaaaaaaaaatgaatgacctgattaaaaactggattaaggacttgaaaagacatttttccaatgaagacatacaaatgaccatcaggtatatgaaaaaatgcccaatgcccctagtcatcaaagaactacaaatcaaaacaacagtgatttaaaaaaaagacaagtgttaatgcagatatggagaaattggaatctttgcacaccaccgatgggagtgcaatatagtataatgctgtggacaacagtatggaggtttctcaattaaaaatacaattaccatatgatccagcaattccacttctgggtaattatcccaaagaattgaaatcttccctatttttatttcaatattataaacagcatatttttcctttgatgattaaagctggttcagatccttttattccaaccagattctacttggaatgcatagtttcaactgttggacctgagacaaaagtgaagaagagaacaggatgtacgtaaggcaaggtcaaatagatgcatgtcctatgaggcaaatattgttctaggtgccaggaatgccacaatggacgcaataggtagatttttgggaaacacgaaattaagaaccgggacaatctttataagacagagaattgcaaatcaaataaaagcaaacacgaggctacacttgtgaggggtaataacaaaagtggcaagaaaagtaagggaccagggaagttgcacagtaaatccagaaaaattcttgagaagacctttctattatgctggggtttcttccgaagttatgtgcaaaatcttgaggctactcttgtggcatctgaacctggcctgtaacatatttccagtgttaccccgccccatctgttggcagagggagatctggtcctcttgcagcagtggtggagaaagaattccatcaagtttggggggatttcttgctggatcctcgttcctcgggttgtctcttcagaaccgtgcaatttcgcaagtccttcaaccagtcgagtcacagcaaggcttcaatatgctcagacgacagatttgtctcaagtgagatgctgggtgtgatgtggttaggctgaaagagattaatgcaaaataaaagatgagttaattgtaaagctgagagaaatttgagatggaatgtagttgggttgctgatgattgctgtgccaatttctgttaggtagatgaagcagtaattttggcatggaagccaggcttgccctttggtattggagcattccctgggattcgctcatcaggtggaagatggtttttattctaattttacctgtgagaaagtggtcagcacgaattattcagttcttgactgggagattatatatacctaagctgtgtctccacatgactcagcctttgcaagtcacattgaaaaggaatacaactatgactgcagaagctttgaggtattcccattgcttttaacaagtccagcctaggcatttcactctgctcctcacacaggaaatttaccatacatctgtttaggtacagtttcctctttctgtaattacacattcgtgaaagccacacatacgcaaaataaataaaaatatttttgtgtgttgatgtcattctgctcctttattctacttgctcctacctctgtctccaccctcactaaacacactcatgcacaatgtccagcccatgctactcacccgagccctctagcctagcttgctgcaccattcctgtgccctggtgcagctgttagacaagcatagcctcacaggcagcctgcttacttggatttagggctgcagctgagaggcctatagatgacttttcaaacaagaatctctagggttcaggggaggagagctgtgaatgtttgtataacttgtttttcctgttacattgctagtgtgaacataacattgggcagatagttttgagaattagaggaggaagccataaagaggagagttttcttggtagatgtggaccgtactcttaaaaaattttgccatgagcaatggaatagcttagtttgtttgttcattagttatatagtgccagaagttttatttaaaagttcactttaaatgtttagtattcatctgacaagaagaggtaaaatgatgatacacgaactttagtttgaaaactgaaggtaacatcctgaaactaggagataaactgagtcttgaagttagatattatataacccaaaaaacgatcactctagattatttctgaagttatggtctgaaggaggccatctttgaaagggtatctgcattcacagaaagaatgtcacagaactgggatagggattgatccatgatgaaatgtaagaataaagatgaccagacagagagggagaaagagacaagaactaaagacaaattcaaatggattctagattcctaattcagctcttaatagtggcatataatgtgatctttaagggaaaaaaggtaggaaaaactatttggacaaatgaaactttacagagcataatcttgttgaaagcaatttagttaaaagcaagatggtcagcagattactttggcagaaatatgatgggttctcaatgacaatacctagacactagttttttttttaatcctagtcatctttggtgcaccatggggacactttgtagaacttcatacatgattagctattttttccccaattttggggtatttttctacttttttcattttgatatctaatatggtttcagacttagttgtgtttaaccaataattcctcattattttgctttttgtttttacattaataattcaaattaaaatgatttccacactactctgcttaccataagaggatgttggaataaaacatttgggaaattgcctaaataaattatggtaggttacaaaatatgatcctattttggctaacatatatatttgtataataagtaataaactaacttcatattttagaaatagatttgtatggataataaaaaggttaatggatgatttggatgagtaaaatttcattatttatttatttattctagagatggggtctcactctgtgaccaaggctgaagtgcagtggcacaatcatagctcaatgcagcctcaaactcgtgggctgaagtgatcctcccagctcagcctcaggtgcacacactaagcttggctaatttttatttttatttttgtagagatggggtctcactttttttcccaggcagatcttatactcctagctttaggtgcctcccactttggcctcctaaagtgtcaggattgcaagcataagccaccatgcctggcaaatcccatttttttttatgctctcattttttctaattttattttttattaaaaaatacatttgacttttaatacgggaaaatagaaagagaaacaaatcataaattggattattaatttaagagacataaaattttgaagaatgaggtttttgtactttaataatattaattttaaaagaatcatgcctattctatttatttggctgtgtttccaactttgtacaaggacataaaataaacagcttttttaaaaaactcatccacctttgttagagttttaggtcattctaatgtttccctattgaaaatgtgaaagagtaggcataattagataagagtgaattagaaatactggtaaaatatagagaaataaacaggtaatgtgggaataattggctgataattggcattaaaaattagacaatctggtcgggcacagtgtctcaggcctgtaatctcagcactttgggaagccaaggtgggcagataacctgaggtcaggagttcgagactagcctgaccaacatggcgaaaccccatctctactaaaaaaaatgcaaaaattaggtgtggtggcatgcccctgtaatcctagctactcgggaggcggaggcaggagaattgcttgatcctgggaggcagaggttgcagtgagctaaggtcatgccactgcactgcagcctgggcgacagagcaagactctgtctccaaaaaaaaaaaaaaattagactatctaaaaagttctaatgggtggaaaaatgcaaactttctacgatatgcatcaaaatagtctaaataaataacgacagattacaaaattgtgtcatgatctcatttctcctcataaataagacacaattatttatataatgtataatatgcacattttgcattttagaaatgagtctttatgaatattaaaaaggttaatgtgaggttgcacaatatacaacaaaagaatacttgaataatcagttcctattgacattcatttttgacacaattcttatacacactaattttgagcaaattgttgggttgaatcgcaggtttcagctgaactatgttcagtcaaatttaagcaattttttttctaccatgtatcttgaattgtatcatatattaggcaacccagggctactagaaattgtggctaacctgaagaagaatcttgcaggatctgatagaggtgattgaatatggaaaatatggaatacttgggcatgaaaatttgatgggagacatattgagaaacacataaatgaatttaaaggagtcttcaggatgtgtgctgtaggttgagggagaaggtgtgtgagttcggggaccatgagtccccagttctgctaatgcaagaacgtgtaggtgaggaagtcttggtggattttaattttcctttgggaaaatagaatctccaagtaccttcatgatacttgttcactcatgtaaaaggtgtcacgtgtgagtattcactccaggagagtcaaaatatacacatagattggtataaatattatacattttcattgataatcaaatagttagatgatatcccaaatcatataaagaactactgtgtggcagttgaatgaaaagatctgaatatattaacatggaaatatttttatgatattattatgagaaaataattttgcacaaatttttatatcacatgaccccatttatactaaaacattgtacatggcctaactttttattcatttatgtatatctgtatgtaaatgcatagaaaaacattcaaaagtaacaaagcacattgttcttattcctgagaatgaaatgagaataggtgacgacagtgggcgatctgtacttttacccaaaatacattagtatcgtatgcatttgttacataaaaatatattcccatgttactagcaggtgtggcaaatatgaaaagcttgagtaactcaaagaagtaaataaagaactaaatggaagaacatctaaaatttaaatttttaaagtagctaacatttaaatgagtcttcaagtgtttcctcctcagaaagatattttttcctccacatggaggaaagaagagggcaagtgagaagataaaaattattgaagatgtacatgctcaggagttagtcatatagttgtaaagatttgcttttcgtaagggtagagccaggaattgtatctctacaactatttgggtcaggtctggataaatattatagtgctttcaatagaagtttaaaaaagaatttttaataatgaaaaaaattctcttaagtattttcttcgtataacttttccctagaaagtgttacatgatgaccaaaggtaataaattacgacataatggttagctagttggagtttcatttcaaaggtatttaagtacctcaggttgacaaaggcttgtctacatatgcaagatggattaggtaattatacacaataaatcagggtgaaaaacctattacaaagcaaaggtaggggtgagggctgtttctgtgtctaagattgattgcttaaattagttaaactcactgtgttctttactttgcaagaacactagtgaccaaacgaacacttttcctactgggtcagtatcttgcatatacaaggttctcaatgaatatttgtcataaaaaattgaatttaaatgtaagaatgctttcaaaacactacgtattcatttaaaactctgttgttttgcctaatttataatattttggttttagtttaatgctctatgatattttatttactcttttaaaagctaaaaaataagttattaataaattattcaacatgttaatttttgaatcagaagaaagcagaaattaagaaactgatggtaaaagctcttggatagtttggctcaaacttgagtgataaatggacaatttagaaggaattcacccagacatcttccacacatgaaggtaccccagtggctttttcactgctctcattcttctctttatcagtgttaaacagcttatcacgtgcatctcagctctaaagtgcttgcgcacttcctccagccttttccaaagcatttctacactctctttaccttaaagcaatgagaaaacccaaaacaatctacacagcactgggattgatatggtttggctgtgtccccacccaaatttcaacttgaattgtacctcccagaatttccccatgttgtgagagggacccagagggaggtatttgaatcatgggggccggtctttcccatgctattctcgtgatagtgaataagtctcgtgagatttgatgggtttatccggggtttcctctttcactcattttctcttgctgctgcctgtaaagagtgcctttcaccccctgccatgattctgaggcctccccagccatgtggtactgtaagtccaattaaacctcttttccttcccagtcttgggtatgtctttatcagctgcgtgaaaacagagtaacacagagattaacaatgtggtttaacaagtttgctgtataatgcttagaaattccatacaaaataaactatttacaatggcagcaaaaatatgtggcataggaataaatgtaaaagcgacatcacatatttttgctgccactgtaaatagtatattttgtatgcaatttctattttggaatattataaaacattagctgaaaaatatcaaagaagacttaaataaatagaaagttataccatttcattggcagggagaactcagtatcatacatttgtcagttttcccaaaattgatccagagattattgacatttccaagaagaattctaaaataggttgtcatcaaactaaataagcagattaaaatatagatatagaaaagcaaagggcatgaatgtccagtcacacctgaagaaggagattaggtcaggaagacgtcccctatgaaagacaatgcttattaaaaagctgtagttgtgatatagtggatattaattcaagaaaagccaaatagttgaatgcaatgaataaagaatctagaaacaaagacacatgtgtgtaaaaatatagatgcatgacagaaatgaaactgtaaattggtggattggttttggagcagttagctaaaaatccattccagactgatcaaaaaattaaataataaggaacactaacaaatgttaaagaccacatatgataatatatttatgacttggtggtggcaacatgattgtcaaataagaacaaaatgcactagccgtaaaggaaatatggttaaattttatcacattaaaattaggacttcatgttcatcataacacacaaaaagagagtgagaaaacaagcaaactatgacacaagaccagcaacacatactagtgataaaagtcagggtccagaatatataaacttgaatatatatagaaacaaacagctcgacggaaaattgtgcaaaaatatgaacaggtagcttacaaaagtgcaatcatgaattactaatacatctatgaaaaaaaatgttgttaaatcccactagaaatcatgaggatgaaggtaaaaatcacagttagctgccatttgacaccaacagactgggaaaacaaatttaaatctgatagtacaaatgttcagaagattgtgactcccattaatcagcggtctttggggctttacctagtaatggtaaacacgtacgttacctataaacacagaaattccactccttggcatataagctaaagaaactcttgcctatatgcaccaagagatatatacaacaatgtttgtagctgcattttcacaaaagcaaaacttggaaacaatttggtgttttctaaaaccagaataaacaaatgaaagtcacatatttaaacatgtatgcatctcaaaaacataatactgagcagtaaaagaaaatcacatgcgcacaaatacacatttatatttggtaagatttattattataaaagctaaaattaggcaaaactaaatattgttcaggaatattaatattttcatataagtattgataaattcaacataataaaataccaaagctattgataatgtacaatggtggctaaatgggtagtagcctttttatcattcttacatattatccgttatatatagttggcatatattttaaaacaacaatatgaaataacgtgatgaaaaaattaacgaagctacaacatgaatccctttttgagcaagttgtaaaaagagatctgggagagtttctcctctctgtatctaaaagtaccatctcatctatatttaagacgtcgaatatagactcatgcagttttggtttaactctttaaaaacggctttcaacagggtttcatgctcccttaattgcttgttgttaaaaaaaaacctattttctctgatgtcttattttaatttttataaaccagtttagtttaaaaaacagtgagttactctagcatttacacttgatttgctttttaaaaataccttctaattaagaaaaaaatcatagtttaatatagagtcattaggacaggtgggggtgggcggcgagggggtggctggacttcctcgggagcgcagatctgtgtcctcgcggagatcatcgttctgcacagaggaagtctgtgacgtgcgctgccacccgttgctcctggcagcagtgaggaaaaccagcttagggaggcccggggagcacagcagaatggcaagcagactgccagccagagggacactgttcagtacaaacttgttgactcggggcacagtctggacaggccgtgtgacagccttgtgtttcaattactccagcccaaggaggcaggaaaaaggaccatctaattgagaaacaggcattgtatctaaattgagatttccaagggtgcatccttgttaaaaaggagaactcatggttaggtgcagcctgccctgcaaagcctgggtcactgagcatcagcaagcttatttttaaatcatctttttttttttttatgatgacacctccgactggaaatcattgacttggcagaatagcaagtcacacattaagcaacaagcgaaatacactaatcgtagcttgactgttttgtaaagaatttcacagcacaaaaagttaatatcattgatttggaggaagtatgtaggggaaacccatatgtagtgagtatactaattgtgacagctcttttaaaagcaggcagaaggcattattgctgaggcagcttgaggagctgtttgtcattttaaaaaagcatggaagccacaaaaaagagttgggcaaggcttgggagaactgaggaattatgagaataaaaaacaaaaaccggtaaaaattctcttccatttcatttgaggagctcggaattcaatgctttctcttagataatgagagagagcagttagaggcagacggaaacagcacgaagtgctcattacttttaaatgtgcaatttaaatactcaagtgtatccatggaaaaaaagatttaaatagcaagcttcattactatttgctcctagaagacaatgatctctgcagattgccccattctgttgaagtcaacatggagatgaatagcaattttgcagtttgagaagaagaggggtatgtgggaaaactgaaatgtgaacaaaacaacagttgggcctttttccattgtttatgggtgctttgggaattctctgcagctttatctttcatgatggcttaataagtaaaaatacaggacatagtctacatgtttgagacatgattcacagaatggtactaattcacctaagggcctctgcctggcttagtccacatagcacatctaagcatctggaatcacaatggcaatcttcccaaaggccaagggctttagttattttgctggttatgtacatagaccagcataaactatgcagccatctgtatttttctgtaccaagactgagtaaaatgaatttataattttgaaagtgttcatccttgatgaccccttcacgctaatttttattcttttcaaacaactgtagggtctgggatgcccggaactctgttcactccaaatgtcccatccatcctcatttgcctggttgcccacagctttgccatctcagtatgttccccacacaacgccatgggcaatttgtaagatcgctagcagagcaggctcttgaaccacgctgcctaggttaaaatatccactcccagcttgctgtgtggaatgttgggcaaataacttaggttctctgtgctttctttcctggcttctgaaatttaccgaagagtaataatacattcccattcagttactgtgagggagaacagagctcagcacactggcatgcaataggtgctcagtaagcgttatatgtagtcatccacaccacgcatcactactgtgactgtgttccaccctgaatcaaatcactttctctgtcagcaccaactccttcgactggggtgagtgtcagcagcgagtgacatgcagagccacaccagggcccacagcgtttcccagagaggagaggtaatccacaggggaggttcagaatatggagcctcctaagatagcatccgtaatgtcgcaaccttggggatatcagaagaatggcaggtgatttttttttttttttttgagacggggtcttgctctgtcacccaggctggagtgtagtggtgccatctcggctcactgcaacctctgcctcccggattcaagccgattctcctgcctcagcctcccgagtagggactacaggcgcccgccaccacgcccggctaatttttttttttttttttttgtatttttggtagagatgggttttcaccatgatattttactgaaactaccaaggggggaaattgaataacagagaactccagagtgtgcattatcacaaagggcaacttcaggtagaagtctcactgatgttcctggagcctggggatcttggtcatcaaggaaaagctgcacaaaaaaaagacagggtaaaaggacttctgattttgccagaagagcagccaatgttatgtaaagaaagacagttgaacccttaggttattttaggtcataaaaaaagacttgattaaaacacatattgtagagaaaatttataaaaattttaaggatgccagttcatgtgtggacataagctaatgaactggctggggcaaaaccactggatttttgatgatattctaaggaagatggcttgattcctggaaatgaaatttattaatagaagagattaccaggcctaaggcatatatgctattttatattaatttttaaagaactgagttaggatgtattttacatcctaataggaattgtaaataaaaaataactgtttgacaattatgcagaaatggttttgtattcagtcttgttgtctgtcattgtcatcatactcttccaagggtatatatttttgtgcaacttacagtccaaaggcaggaaagaacccacaaggcctttgcttccacttagatggagttagaagttgtttccataaggtgataagagagggaatttagttctcattatttcacctgcccctacaccctccattcatccagatagaaagccttttgatagaattactcattgcccttctagatatttaggtagcttctttaaaaatacaattcattagatgggcagtggaagttgaccaaaatattcagggacctatcatagtaagtattgatttatgagagcacttttctcctgacagggggtgctagggaagcatggagaacaggagaccaactccatgggggaaagatgaagagcaatggtgtttttgagcatgggccctgaattaagtaagacatatgttcaatttctaatgttgacacttactagctgtgtaaatggccttgggcaagttcatggtacaagctaagcctcatatttcttcatctaaaacaacagggattttagtttctgttgtattatgaaatagatattaataataattattgagcaattagtgaaactgttcataaccagactgactgtaggcaagtatgaactctaacagattaactatgtgtacagcatagagacacacaagtggataatgtgaagatagaggaaaggacatatgcattcgaatttcaatttgaatttcacagcggtagtcaaataatacctaccatcaccagaagcataagaagtccccatgcagagctgtggttttctagcccttcttcacgcttccccatagccttgatgggctagatgctggccatggttaccatgcactcacctggcgagggctttgttatagcttcatgagtctcagaagttggacctgctggctttagagtccgactaattttgtttttctcctagaagttgtttctgaatggataatttggtgttagacaattagaaattcactggatttctggtctaggcaagatacatttgattgatttttcttttcatgtaatcgtttctggtaagtctctgaatgagcatgttttcaagctttttattataaataacaaagcaaaatacaagttatagaaagacattagagctttcttctaatcttcttgcctgttgtcagtctcctttctcctttcttccctccattccttcttcctccttcccttccttcctccctttgtacctgccttcctttcctttttttttttttttgtttgtagtggacaaattagttatcatcaatttatttctgaatatctcaaaacttgaaatgcacaaacatatgctgttagtcacaatacttaaatcaccaagtgtcctttttattttttacattaaccatagctttgggttcaactatactggagaattctattccattgaattaaaaattgcacttcaatatcaatactgcactaaaagctctggcattgaattggtgtaattttaaccttctaatagaaatggttggtgtggggtttctatccagccagcacatgctttaattttgagagaagttctttgaagaatgtctaattgttttcggaagtatgtccttttgttttcataaagctcacttttccattccctgtgccaacatttttagccgttgtgggattttctacactgttgcttgaaagtcaaatttaaggtcttaggcaatttctgcttaaaaattccatgtgacagatagaatggaggttgagactgaattgtaccagtgatcaaattaggtcagctctacacagccatggctgaatatgtataaaaccaaaacatttaggctttcacgttattactaagtcagtctctccccctgccccaccaaatagaatctatctttttattgttagaggaaaaattgttctatggtttgtttttttaatagatttacaaacctctgagtttttataaaatacaatgggtatttaattaacttatgaacttaaagcttaaaccacattatttccttttttaaatgccgaatggaaggagctcttctgatgggtgaacctacccttccttcatatagctcagtccgtcaatatcttgtctcagcatgtcttttttacaattttacccaaagagagatggatagaacaaggttggctaatggccagatcaaggtggggaaaggaatcctagtgtagataatttaacccctttcctcctgcctgtccttacatccacagccctatgtggctaagcataaagagaagtgctgcaccttgactgctgaattctgaaaaggtacagaaaaagtaagtggacagaatagagaagaattacaagtcagatagatattcctctgatgagtggagggtgggtgcagaaaggcaggaggaaggttgcggaaaacctagtaacacccatgtagtagagcgttcccatgaaacaacttccagactcggagaatgaaacctgtttaccaatgtacctgctcaaggaggattttcctgatccccttttccaccctcattcgctcatgccccaacctggaagaacagaagtaatagctattgaaaaagatagaaaaggagagagaagctggtcactcctttccttagctacatgaaagagaatcttcaagtgaagatcaaggtgttgtttcatggaactaaacgttctatatattttttaaattcgtgtatattttatgtcttgaatgtcatgataggaccaaattccatgaggtcctctataactaggacagtgaaaaaaacctgacttgtgagatacttatcacaaagcaaccttatctgaattctcaatttaagttttccaggataatttaccctacttttggattaagaaataaaaatctggctgggcgcagtggctcacgcctgtaatcccagcactttgggaggccaaggcgggcagatcatgaggtcaggagatcaagaccatcctggctaacatggcgaaaactctgtctctactaaaaatacaaaaaattagccgggcgtagtggtaggcgcctgtagtcccagctacttgggaggctgaggcaggagaatggcgtgaacctgggagatggagcttgcagtgagcccagatcgtgccactgcactccagcctgggcgacagagggagactctgtctcaaaaaaaaaaaaaaaaaaaaaaaaaaaatctaatctctctatgacataccggaaaagcatagaaaatccacactatttggaatagttcatgttcgtggataaatatttgataatttataataccttcagcagctaggctcgcaaaagagcttgaaaaaagtgtaacattatgaatgacatatttactaatttttggtctacctcgaatgatatcaaatttcatctttggtcatgaacattcctaaatcctgatagagatatacaaggactttgaggcatcttgctgttgcatcttgaatgtaatccaacttctccatgttgtatttacctgaatagtcaagatgacttgacacaggagggcatagggcatactacagttcttgagtttttaaaaagcattataaatgtaaactttagaaacttacaaagaaaaaatgcactgatcttatttgtgcaacttcctgagttgtgataaatgcaaccactcatgaaaccactgtccacatcaagatataggatattttttatcatgcctgaaaattttcttttagcccctttcagttaatctgcatagccacaggaaaccactattctgatttccataatgataaattagttcacctagtctagaacttcatgtaaatgaaattatataatatatactcttctctttccaggttccttcacttggtataatgtctgagattcaaccatgttgagagtatcagtagttaattcattctattgtatgaatctacaacaacttgtttatcctttctcctgttcgacattggttgtttccagtttgtaactaccattaacagagatgttctcaacattttgtacaagtgttttcaaaagtaattttcaaaatataaactttgtacttttttgttgtgtactcctatgcacatttactttattgtttttgatgaaaatatcaataggattgtttttcccagatttattgaaatataattgacatataattgtatatatctaatgtatacaatgtggtgtcttatacatatacaatgtgaaatgattaccacaatcaagctaacatatccaccaactcacatggtgacaataaccattctaacagttatgaggtgatatctccttgtggttttaatttgcatttccctgataattagcaatgttgagcatttctccatatacctgttggtcatttgcatgtcttcttttgagaaatgtctattcaggtccattgcctatttgctaatcatgatatttgcttgctattgagttattagagtccttggcatattttgaatattaatctcttatcatatatttacttgcaaatattttctcacattccatgggttgtctctttattttattgattttcttagctttgtagaagctttttagtttgatgcagtctatttttgcttgttttgcatgtgctttttgctattttatcaaaaaaatcattctccaaatctacatcaaatagctccatgttttcttctagttgttttgagtttcaggtcttacatttaagactaacccattttgagttgatttttatatatgatgtgacataaggatacaatttcattcttctgcatgtagatattcagttttcctaacaccacttattgaagagactgtcttttattcgtgcgtgttattggtgcctttgtgagagagcaattgactgtaaatgggtgcatttatttctgaactgacaattctttattattaccatttttaattgacacataataattgtacatatttatggagtacggtgtggcattttgataaatgtgtacaatgtgtaataatcaaatcagcacaattagtaaattcattacctcaaacacttatttctttgtgctgggaacattcaaaatcttctcttctagctattttaaagtatacaaaaattgttgactatagtcatgctacaatgctatacaacagtggaactaattcctcctagatagctatgattttgtattcattaactgacctctccccagcctcctctcctgactacacttcctagtctctttattctactctctacttctgtaagatcaacttttttagctttcacatatgagtgagaacatgcaatattcatctttctgtgcctggactattttattgcacataatgtcttccagactcatctatatttatgtgattgacaaaatttcattcgtttttatggctgattagtgttccaacatgcatatacaccacattttctttatccgttcatctgttgttggacacttaggttggtttcatatcttggatatcatgaattgtactgcaataaacataagagtgtagatatctcttcagcatactgatttttttttcctttgaatacacaaccagtagtaagattgctggactatatagtaattctatttttagttttttgaggaaccaccatactcttttccataatggctgtactaatttacattcccaccaacagtgtatgagttgctggtttgtgtattctgttcctttggttaatatgtctgtttatataacagtaccatgctgttttgtttattatagctttgcagtatattttgaaaccaggcagtgggatgtttctagctttgttcttgctccagggtattttgtttacttggggtcttttgtggtgccaaacaaatattagaatttctttttctatgtctgtgaaaagtgccattaaaattttggtagatatttcattaaatctgaagatgtccctgggtcgtatgtacattttaacaatattaattcttccaattcatgaacacatgatatctttccatttatttatatttttcaatttttgtcatcaatgttttatacttttgagtgtacaaatcttttatctccttaaatttatttctaagtatctttttttttgatgctactgtaaaaaggattgttttcttcatttcttttttggaatagttcattgttagtgtatagaaattctactaatttttgtatgttgattttatgtctttcaactttactgaatttatttgttagttctgacaggttttgtggagcttttagtttttttatataaaaaattcatgtcatttactaacagagacaatttaacttcttccttttcaatttggaggttttttgtttctttctcttacataatttgctagaactttcagtactacgttgacaagtggtgacagtgggcatctttctcttgtttctggccttagaggaaaaggttttagcttttctccattgagtgtgatgttttccatgggcttgtccatgtgtggtctttattgtggtctggtacattttttcaatacctaatttgttgagttttcatcatgagagaatgttgaattttgtcaaatgctttttttttttgcatctactgaaatgattatatactttttgtccttcattatgttaatctgatgtatcacatttgttgatttgtgtatgatgaaccatccttgtattccaggcataagtcccactcaatcacagtgagtgatcctttgaacgtggtattgaattcagtttgccagtattttgttgaggatttttacatctgtattcatcagtgacatttgcctgtagttttcttttcttgtagccttcttgtctgattttagtatcaagataaggctggccttgtaaaatgagcttgaaagtattcctttttcttcaattttttggaagagttagagaagaacttgtataatttctttaaatgtttggtagaattcagcagtgaagctatcaagtcatgaggttttctttgatgtttttgagggttttttttttatcatttctaattcaatgtccttaatctttattggtctattcatgttttctactccttcatcagttaatcttggtaggttgtttgtctccaggaatgtatctgtttcttctaggttatccatattgttggtataccttttgcacctctgtggtgtcagttgtaatgtcatctctttcatttatgattttatttttatgtcttatatttttcttagtctagctaaaggttttggaattttgtttatcttttcaaaaaatcagctcaatttggttaatatttttattgttttttctgatgtctatttatttttgctctgatctttattattttctttcttctactaaatttgggcttactttgttcttattctaattcttggagatgtaacattaagttgtttgagatttctccatttttgatgtgggtgtttattgctgtaaatctattagaaatgtttttgttgtatcccatatattttggtatattgcatgttcatttttatgtcttgaaatatttttaaattttcttttaatttttttctttgacacattgattgttcaggaacatgtttaatttctacatatttgggaattttccaaaattcctcctgtcattgatttctacttttatagtattgtggttagaaaagatacttgatatgattttaatcttcttaaatttgttaaggcttgttttgcgacctaacatataatctatcctggagaatgttccctgtgtacttgaaaagaatgtgtattctgctgctgttggatggagtgtcgaatatatgtctgttaggtccatgtaatctttattgttgctcaagtttgctgcctttgacctggagcccgtgtctgcaggggctggcctaacaccagggtttaatggggtgggcttggtagcagggtctgtggcaaagtcaggttctcattttcctctcttttacctttgtggaggtatctctcagcacagtgcttcctgggcttaggagaggagtttcaaaagtaatatgaaactctcctaccctcttcaatgtgtgttttcttattcctgtgctctacccaggtgctgtaacctctcatctggttcccttggctcttgtgaaagtatttttatttgtgaataattgttcaaattaatgtttctggaagggatgagggctggaaacttctatctactatcttgctgatgttgttctgtcttgagctgcgtttttaagtagcatgctgcttcttgctgaaagagcatctaacaaccttaaaataggactctggtgaatacttccacaccttcaagcatcagaagtctgccagtctgtgattccaatcctttcccaacaaaagtcaaatgctagcataattgagagaacaagatggttgtcaccttgggaagtaaggagtatgaagaattattcaggcatgtgtcactggggatataggtgccactgatgcaaacaggaaagtgaggaagaaaaagtatgatagggtttgagtttaactttaggtaaaaacaacactacttatgaactgtaatggtgattaggcaataggagatatttacagcgtggactacagtgtttgatatcagtatttagaaatggtcaatagaaaggtaattcaggttgaggctattagaaaaatgctgatttgacactgcgagatgttggagttacaagagaaaaatgaaaagcctcaaaggtaagagaaagaaagaaaatgttccttattttgatgatccaaattcttaggagtcaaaagttaaaaaaaaagcttattgtaaaaatttatgattattaagtaacttgattaccattagtaaaaataccactttttaaaagtcatagttaaataaaagtgtttgaaaataaagatggaaggatttcatattaggggaaaatattgtttataaaatgtaagtatatttaaatatatttaatttagaatacatcaaatgcccttgtaaaatattagaaaattaaaacaagaaaacagatctatgaacttaacttatcccagagattgacatatttttcttcatagttccaacttattctaaaagtaaattttactcagaagtttaaaaatactattaatcattaagagttgtgtttattggaatctttttatggtagccttgcctaattacaattaagcttatatttaacttctgcaaatgtcaaaataattaataaagtaatccaacagctctctctctcactctcttttctctctttctctctctgttctcctacaaatgtatatatatccatgttcaacgtgctgcactaggtgctttggctgacaacaataaggtagagtccagaggtaatataaacacatacgcaaataattataatacaagttagaatattttctggttcattagatatgaattattgagtggtggttataaatgttgaatacattctctattcattcctgattgattatagttaggtagcggtgtaaggcaaattttgatggaatgatggctaatttcaaaaatctcaatgctataatttttagaaaataaataggtatattatgaagcaaataagccttttgctccgtttagaatttcacattgatttatgtagtttcctgaagaatatttacggcaatgtaattaattttgaatgttcagataatgttattgtcaggccatgcagacttaattcatagcaagctcttaggcagaagaagtacataaaatccaagctgttgactattagtttcagtaagtgcattgaagcaatttttaacaagtgctctttaggtaattcagattttagacttaatcataaacctttctagagcatttctatgccaactaaactttaaatataaacagaaaaatctgtatgccaatatgttaataaaatctaagcatgataaagaaaaaatagacatgctcactgagattttaaaagttaaaacattgcttactacatactagtcatagttgaagagaatttactaaagattttggactcacttagcagtgtgcacacatatcttacttacataattacttgaagcaaccacttgaatccatcttgttcattttgcattttataagaaagaacaaactaattatgactctacacagaagacaaatataagccttgtttgctgggttcatttagtcgtatacctctgccgctcagaagagcataaagtagagaaaaagcagaagtggtcattattctgcatgttgtagcagtgtgcttaaaaggttaaatatcccctggagccaactgtcactaaaggatggaagggatgctggttttcttccatgctagggcacaggcagcaacatgctgatcaggaagccatacctcgagagaatgacttgaaatgggctaatgtggacagagtgaagatttatgtgctgtgatggaagaatgaggaaagtgctagcacaagacacaagtcagcccgatggcaagcgaaccgttaacgtgagctgaaattcagtgcaatatacaaacaaggggcatgacagagagaaaatatttgaatatctgcgtatgtaggcttactctaaaggagaacaatgttgcctcttcaaaggtcttcagttgaactatgataacttgatatgtgctcccttaaacttatgtttagagagaaatagacaatttgagaacacaagagccaaagtattataatgcgatatatttaaagatttcaagccatggttactttcacagacaacagcgtgaagctcaggtggcccaagatattcaattctgtctagagctcactaggtgtggtcttggatcaagttggtgctggaacaatgatggatatacaactcgaaagatttatattcattctgtggcaactcctaaaaatgccctacttgtttagggtcttctatatgaggtgccaaccctgcagctacgagtgtaggcagggctcacctgcccaaagtgagagacgagcatccttcataagcagaaatatgcttggaagtggaatcatagcttgtgccgaacagtgagcaaagcttctatgtaagccatgtgaatgggtgatggcactttacagatctgtcaaatttacagccaaaatattggtgtcacttcagttgctttattaaatattacagggtattatatgtcaaattttatttctagttagcaatcctattacttcattacagatttggattataaaatctgaagtgagttgtcattttgtagcataactgtatcatgtttattttagtcaattacatagttgatttaaaaaactgattttctgggtcacacaaaattaattttcatattttttacaaatttgtcacaaagacgaatcaatgactaatacgtactgcattatgtttaaatgattgattgtatatgggtgaagctacttctctaattataaaactttcccctgactgctttctatgtgtttaccctgttggagtaagaaagggataaatggcaacaattttcttttgaaatgttatattttctgaatttatatatggacagtatttttcccacagttacatgatagtaattgattgattaaattactatcatgtaactgtgggaaaaatactgtcaatcaattcataaacattatgttgaaaactatcgaccactattagtttaattgggtttatgttgctcttagtaggaactaaactatatttactagcaaataagaattcattgtagatctctgttgggagacaatcctcttttcgtcttttgcattttggcatgtcttgggagcagaggtggtaactgctggtcttccgtgctatttttttcaaggatttgtttagtagcagatgccttggaagataaagataagtgtctctctccagggaaagagcaggtttgctgaaataacaacaatatcttcctttagaagccctattgtaggcttactgcctacaatataaaatactggggaacctaaaggcagggttcctctcctgtaatacaatgtattgccactgcaggtacaggtgtcctctacttctctttaagttgccctttaggaattaagcttgcagaagtaagacaagaaaatgctgatactctggctactgatggttcttgagtaataaagtcctttgcctctgacctgtgagtcccatgacttttgacagaacccatgagactgtgccaggctaacttattagcttccaagtaggataaaaatctcggacccttcattgttcttggcagtatcatgacacgaaacaaagaacaatgggagcactttaagaggagagaaaagagaaggagacaaggttttcccttcagacactgtgaatttctgcccttggcatgaaagtgtgtatgtgcattcaattaagttaatatgatttccttagattgtcataatctcctaagtgtgtgtgtgagtgcatttacaagacaggaggcttctgacagttgttaaaaggattcaggagcttagattgtggaaacagctggttgatttttctccatcactttggctaataggggaaatgaaagaatatactaggtgattttatatatatatatatataacttttaactttaggtctatagaatattgagggatagttaagatttgatagacttctgaactgatctataaaatgaactgtgtgcagtctttgcctttatgtattatactttaatggatcagatcagactttctctcaaattctttttgtctagagcaggcctggtgagtgaaatacaggtggtgtgacttctgcaaaaggtggattagccccaaacacgtggtgcgcgttcacagggattctgggaaaaagtcttcctgaaataaactcttccatttgctctcagatgcctggaattctttaccaccaaaaggaaatcctttcatccaatgtttacagtaaaggattacaatgcacatacactgggaaaggtatgcttgcttaagctggaaccttgctgtacaagaataatagatttcctaatagctggtcttcagtcttaaactggtggtggtaggtctttatatgaaagggagaaatacggtcagaataattttgttaattaagataattctcattacccatatccagtgccggcaagcaaatttttatcgtgcatgcaaacgcgacttgattgtcagtggtttcctagagggctgctcaaggattctagggcatgtccaggttcattgagaccgctctgttgtcagtgagccacggtctccaggagcatcaagggaaagttgttgcacataaactagatatttggttcccacattattagctgcaaatggcttactaaaagtaaatgtgtccatttccgatatcctgtcatctagtagccaggagctgatgtcaaaaattaatggcacattttcatttcttgtctttctagttctcccttcggcagcacctacagcatattcttgcttctgagctgaatatctgcgttcctgctaaaccagagatcacagttatcaggtgattgatcaactccagtgtatcaaatcacaaagttgaacaaccatatcatctaattttagaccattttgtcactccaaatctattgtacttattagaagtggctccccatgccttctccccatctctaccgacctctctgtcctcaactctcaggaaccactaatctatcttctttctctatagatgcctcctctggacatttcatatgaatggataaatataatacgaagtctttcgtcactgctttctttcacttagaatgttgtagcatgcgtcagcacttccttcctctttatcactgagtggtattccattgtatggataggcctcacttggtttatctactcattagtggatgtagttggatggtttccagctttagcttttatgaataaaattgctatgaacattcctgtgtgagtttttgtgcagacatatgttcttatttctcttgggtaaatacctaggggtgaaattgttggaagatgtaataattctgtgctcaacattttgaggaattaccaaattattttccaaactggctgcactattttacattcctactagcaatgcatgaagattataatttctacacatcttagcttgtattttagttataatttccatgtttctctcccccaataaactgaagattgaactctattttgagctatttttcattcatttttatgttatcaggaatctctaaaatatgtaaaaattagaagagggatggaaggctgagtgtggatataacttgacagataggaaatttaaaaacttaatctaagattttaacactttttcttgacctaatttttcctgaccttcttaatgggacaggctctaatgtgctatttagcctgattttcacacatattattatgagtactcaaatctaaaaataacaactttgtcaatatttcctcaggactatgaccagggtgccatgagaatgtgatattataatatcatctctgcacttaattttaaagaaggaaatcatattcaaatgacaatgccttcaacagtggttccatgaaaagaatagcaaatttctgttcaacaatgagcgtgagaaagaaaaacaggagaactcaggaaatatgaatagtttaagttagttcagccattgtgggaaacagtgtggtgattcctcagagacctaaaaacagaaatattattcaacccagcaatcccattactgtatatatacccaaaggaatataaatcattctgttatgaagacatatgcacatgtgtgttcactgcagcactattaacaaaagcaaagacacagaatcaacacaaatgcccatcaatgacatattggataaagaaaatgtggtacatatacactatggaatactatgcagccatacaaaagaacaagatcatgtcctctacagggacctgggtggagctggaaactgttatccttagcaaactaacgtaggaacagaaaaccaaatactgtatgttctcacttataagtggaagctaaatgatgagaacactggtcacatagaggggaacaacacacattgaggcctttcggagagtagaggttaatgggtgggagaagggagagaatcaggaaaaattactaatgggtagagggcttaatacctggctgatgaaataatctgtacaacagacccccatgacacaagtttacctgtgtaacaaacctgcacttgtactcctgaacttcaaagttaaaaaaaaaaacacttaaagtaaaaataaaactgtacaattaatgagactttttataagtcaaaaaagccattaaataatattctcttgcacgttacatattgaatttcgctacaaccttttctgttttacctaagtttttcagaactgacatagattgtgttaattacacaaaaattcagagggtggcaagagtacatacatttccatattttaatcttcaccttgcaagaaggcacatgtggcttagaagctcttccgtccaggactgaggtatttacctgacatatcttagatgtcagtgaatcaactgtcagcatttattgatcatcttccaggatattagtgctttgcaagtatctctggattaatgagtaaacattttgcaagtgatttgcaagtatctctggattaatgagtaaaagaggcagtgaggaagaggctcagagattattctaactgatgatttaaaaatattttagaatgacttgtgcatggtgattactgaatactcatgaggagccttcagtccacctgtgctgggcacacatcaagtctccatgttgtataatgagtctttttatgagttcacaatttgtgtcattgattttaacaaattgacatttattatctgagcaagtttaatatttccccaaaccttcagctatgcaaagacatgcttttgatggtaaatcttcagtgttttgtatggaattccagcacaggtatgtctcattttcagaatcactttttcttggaagtctgtcttaaaaaatattacattaaagaaagagaccctggattgtccttaagaaaaaagatgattgagtttagcaaatctacatttccccatatatatctactttccacagtaaaacgaatcctgattctgaaatttccttatgatatttttatctaattttcattttgagggcacagaaaatggaatgaattacacttatcttcatcactggggtttagtataaaacaaaaatgttcccaaatggcaaaaccaagaaaaggtataaaacttaaacataacttttattctacatctatattaatacagtacagaataaactcattgggttttgttcgatcctaaatatagcaagaacgcctattgtgagtctgcaattgaatttttctcacttgaagctactacctaaaattttaccttacctttagacagttaaaataggggaaaaaagaaaatgttttggacaagtattattgaaacatgatttgatcaaaatcatttcgctcatttattttgattatattttcaaattcatataatatatgacatatgagtcatataacatacaatatatatgacatataaaagtcatgtaactcatatttttactttctggccaagaaaatgccatttgttacttaaggtttttcttttagtgaaaattcaaaatcaaataatgaaaaagtgtttaacacaattagaacatatattggaataaacaattcctattgttttgtattgtattgtttggttggttgtccataacagacctctgtgagaactggattatgaatttttattgctacgatctactttgattaattcataattgctatgtttcatgagtttataatgctgacagagttagtatatctcaaagtgcaaattcataaaggaagggtaacttgattctaattcaattacttaggaattcaactttgagccagttggtacttaaagaagtctggatttgttgattttacttcacagtaatactttccagttgccattgctatttatttattatttttgcatattctccacacttatctaagatggctgctatactcagaatttccagagattaatatgctgaggtctgaaaattcaagtgtgcaataagcattgtctggtaaactataagcccttccatgtgaaattagtcttgggcttggttcgtaattggtcacccttttacttccatgcaatccttttctttacaatgagaaaatgagcatatcatttattcattcattcactgatcagatattcatgagagcctactgtaagccaagcatgattccagcaccgaaattaactgtggtgaatcaggcaggcaagctctcagctcttgggaagcttacaggctaatgagagagacagccaattaacaagacaacaataaataaagatcaaagtgctataaaaactacacaagggaatgtggaaaaggggagtctggggcacttcatcagatgggatagttaagagtggccactctctgtagatgacatttgagctgaaccctcaataatgagaaacaagaaactatgcaacgatcttggaaaattacctccagacagaggaagtagcaaggcaaagattctgtgcctgtgattccttaccatttgcattttctgctttgttaggggttctttacataaacatttatccacaccaatagggcatagtaacatctgttcttgttaattttactcagaggactgagtagtttagaggaaaaatcaattggtgatccatctctctactgcaaggataacatactttgttttactggtgtaaaaagtttgggttggactttcttgtgttttcaaaactggttcccctcttgggattagtggcactgagagtcatcatatagaaagcaatagagaaaaaaaagtggctgttgtgaataagagaaaacgggagaaatgctggcctctggtctaaagcaagaacaaaaacctgatatatcttggttttgttttgtaagaaaaatcaatgagtttatcttattttctgacatgttggtgttatattgctgagttgtcatcttaatttctgttcttagaggcaatcagatgcatggatccttaaaaaacagtaatcctgggccgggcgcggtggctcacgcctgtaatcccagcactttgggaggccgaggcgggcggatcatgaggtcaggagatcgagaccatcctggctaacacggtgaaaccccatctctactaaaaatacaaaaaattatccgggcgtggtggcgggcgccggtagttccagctactcgggaggctgaggcgggagaatggcgtgaacccgggaggcggagcttgcagtgaaccgagatcagccactgcactccagagtgcagactccatctcaaaaaaaataaaaaaaataataaaaaatcctgattatcgttctagcggttctcaaactgacttgtgtgtacaaaaaggtgcttcctgtaagtaattgttcatcaccttataaggcttattaggatatatgttataactgtataaatctattatatatatctttatataaacacactcatatatacatagttatatacatacatacttttcatcagaattactgaaatcaactaataccaccaaaccaaactaaggagatagtccccccataaaacttgaggctatgatgtgtctgataagccatggccagaagcttgcacatgcactcaagcacgagcactagtgcacaaccagccaaagtgagaaaaccagtgagataaagaggcctgcctaaggtcacacagaagggcggcgggtagtctgagaacacagccacgactctgggctgccaattcagtccagtgcttcctcctggggaaaattacagaccagctcagacggtacctgcacagacaatggccttattctttctttactctcctaatttgattatttttttcttgccgtaggacttaagtaagacattttggcaggcacttaaaaagaggagtgccaggcacaatgaaagagtccatgggtgattctgctgcaagaccaaggagaaataagttattgatgatgtttaaaggcagagaggcccatggcttactgagtacccagtgttgctgataactctcatcttcttattcctctgttggaaaaaaattatagggttgaattgctccttaactgttttctaaggagaaaaaagggatagtgtttattgcattgatttttttgctttatttaatttatttttcaaaattcttctttaatagcacattgaaacatggatgtgtaaattgttttatgtcttcttatcttcaagtgcagtaactaacaatgacaatttttccagttgcttatcactctgctgcaaccaataatagttattcataagttactctttttaatgcataaggctattgaataatgttagtcttaaactaggtatcttattccatagttgaagactgtagactgtttttgaacattctttgaaccatttcttgtggttcaaatgagttcagccaccactatagtttcaccaagtcttccttagagtgagagtaccttgtcagccttctggacttcagtgtaaatggcaaattgtaaggggtaaataagtgtatgtgtgctttgtaggaaggcaccagaggtctgtgcaagttttgtttgtttgtttgtttgtttgtttttggagacagagttttgctcttgttgcccaagctggagtgcaatggtgcgatcttggctcactgcaacttccacctcctgggttcaagcaattctcctgcctcagcttcctgagcagctgggatgacaggcgcgtgcctccatgcctgactagttttttgtatttttagcagaaacgggcttcaccatgttacccaggctggtcttgaactcctgacctcaggtgatctgcccgcctcagcctcccaaagtgctgggattacaggcgtgagccaccgcgcccggccaagtatttttaaatgtactgtccttgtggaggatttctttgtcatagagctccttcctctagtgaccctttgttaatctgggacagtgtaaactcagccataaactgtcaactcctggagaggggctagagatcattggtctttttatacccaaggcgttgcctggaggccggccccagtgcagattctcaatgaatgtgtgtttgattcataatcatgtatgtactatctctcttctaaaggaacacctttaatcaagcaaaggaaatatagctgtataagtggagtatctagtcggatcaatcatctcgtatagaattttgtgtgtttattcctctttcagtagctgaattgatgcaaatgataaacactaaggtcgctgaacggacataaggtaatgattttcacggtgttttggttatacaatctccaaaacatgcagctttatctataataccattcataagtttaaaaataattggtaaaaaggctgcaactatactttccattgccctaaatatcttccagaactcatcttgaatgacttctccatcccccaccctcctgtgccttctctctgccagaggcttcccagttcgccggcccagactcatcttacaaagaaaatactccgaatcaattggcaagtgcttacaagtcattagcttcttgctgagttaattagaagtcattaacttcaagggttaggacacacagaatacccttgcctggggtttctgaaccgaatttaaagttgtacatggaagacaatatctaaatatccttagtttaagaaatatgtttaagaaatagtaagagtttaagcccccaaaagccccagtgatgttccctctaaaaataagtaaacatgtaaaactaaaaactcacatttgaaaactgtgacctcccaaggagttggactgtagccaaaaagcacattggatccattcctgtatccaaggtagtttttccattggccaccaggtactaaagttccaactcccctgccctagaaatgtcgtggctggcggagcctgggggcattgtcagcctcacatgcaggaggcatggacatgttcaccgcatgcacacacaccttcacaatcagtgcacttacaaacacacatgcacacctaatttctattacttgataatgtgagaataagagccagagtatacctaaaaaggaaaagtcaagctttagaaagtaaccacctaagtaaattccaagtacttgagtctgtacttagtatttgataacttaaatactcatttgtaccacaggcaagctaattttgttagatactcactgggaggtagttctgtaatagtattattgtttgtatgctgagaaatttattcattcaaagagacagtctgtatgcaaatctgacaaagagatttgaaattgtaatgatttcagacatagaaatgttgtaagtatttccaattctgcttcagaacttacctatttagatctttgcatcttgctctcaatcagtgtgtgtgtatctctctcaaaaaatgtatgcaatgaaccaatgctatattctttgattaaaaatagagacatggtaggtttttgatttaaatgataggctggggaatttgacaaccctgctttttatattgagaaattcagttaattcttctaagtcctaatttcttcttgtaaaagatgagaataataaaacatagatgatagtgaaatgaattaatatgtaaaagcacctaaaatagtgcctcgcacataacaaacatcaataaatattaatatcaacgatgtcaattgttgtttgtagagctaacctattctgtcttcatacggatatttttgtactgagccatggttaagaattctaaaacagatttgatttatcccaaatatgaatatgtaggaagatgaagctaggcaatgtagatatttcctgtgactataatctatatagaggtaaaagcttgcattttaacttcaccttattgataatgacttacattatttcctctgtctcccatttattccgtcacattctttgtgatcactgacaatttccacacttgattgggtaccaccttattggaatctatacttgacattgtccttaagctaatgtgtgaacttaaatgagctttagcaaagctttcttcagtatcaatagcaaaaacaacctcacctgccataaaataagcagtttcgggtgtctcgtgaacgtatgtatgtatggccagacacggtggctcacacctgtaatctcagcactttgggaggctgaggcaagaggacaccttaaggccaggagtttgagtccagcctgggcaacataggaagactctgtctctacaaaaaaaaaaaaattaaaaaattaaaaaacacatttttaatgacataaatacttaaatgacagcatttaaaagcaatgctgtcaaacacaccaaatacctaggaataaattaaatgatagatatgaagagtttgtatgctaaatattatgtaacactgaaaaatttaaaaatgattctgaacatcacattcctagattgaagatgataaagatggcaattctgatgagattgattgtattcactgaatgtaatctcagtcaaaatcatgggagaatttgcagaaattgaaaaaatgattccaaaatttacatgggagtacaaaagactacacataaccaagataatgttagttttaaaaactacttaaaatgattatttaaaagttaaaaaattgttcattaaaaattttaattgcaaatattataaaaattgattaaacatgcaattaaaaattttaagttaaaattgtataaattttccaaaccttcatgaatttttactcatatataagcactatgaagtttaagatgtagagttttttcagaggtcaggatggctccctcatgctgccatctcccagtcaaaatcccccttccaatgcctgctcttccaatgcctatcaccatagcatactttcatttgctgttggacttcatatgaatggaatcacgtagaatttactcttttgggtctggatacatttactcaacatggtgtttgagatgtattcatgttgttgtatatagcagttgtattgttgcattgtatatagcagtatatgttgttgtatatagcagttacattgctttatattgtatgtgtgccattccattgtagagtttattacatttaatatatgtactgtactgttaataaacattgtaattgtctccaatacatacctaggagcagaattgctaggtgatagagtaagcatatgttaacatttttcagaatgtgtcagtttttgaagtggttgtaccgatctactgtcccactagaaatatgtaaaattcaccccaaatgcttgccagtacttgttaactggtctttataactgtagccatatcatgggtgtataatggcgtattgttatgatgtgaatttgcttttctctgataactaatgctgttgagcacttttgcatatgcttattgaccattggaatatactcttttgtaaagttcctgttcaagacttttgctcataaaaaaaaattctcattgatttgaagaagttcttttctattctggggaaaagcgctttgtcagatttatatgttgcaaatatcttctcccagtatatggcttatctttgtcactttcttaccagttctgctttgataaacataagttctaaattttactttattttatttatttatttttagacaaggtctgcctctgtcacctaggctggagtgcagttgcacaacctcggctcactgcagcctccgcctcccgggttccagcaattctctcgcctcagcgtcccaagtagctggaattacaggcacctgctaccacgcccggctaatttttatattttttagtagaaacgcagtttcaccatgttgatcaggctggacttgaactgacctcaagtgatctacccacctcggcctcacaaagtgatgagattacaggcatgagccactgcaccgggccaggagttctaaattttaataaagtttatttcatcagtcttttatttttgtggtcaggactttttatgtcctgcacagtcctaagtttataaaaatattgtactatattttcttccagaaactttactgtattttcttgcatattaaggtctatgattcatgtcaaattaatttttgtgtatggtgagcgttagagttctttttttccaataagatattaatgcaacaggatctattaaaaagaatcatgtttgcttccccaactgcatttcactcatgcgtttattgtaaatcaggcagtgatttatgtgagcatctgtttctaaataccttccaatagtgtatttgtctatccttgtaccaataccacaccattttaaacttacagcacttttatagtaagtcttcacatttactaatctgtgtgctattcaattttatttcagtatttcattgggtattgtatttctacatacatatcagaatcatattatacatttctttttaaaaagcctgctgagattttaattagaattgcgctgaatatgtagaacactgacattttatcaatattgactcctctagtctctccttttatttaggtcgtccttatgctgcagatttctagaggtactgtatacttttcatttgattattctcaatatttttattgtttaaattattgcaaatgatagtatattaatttattttcttttcatcaattgctagtgtctagaaatataattgattttttaatattgactttgtatccaggaacttgttgttatagtcacttaatcattgtaacagattctttgtaattcttctggcttctctccattcacaatcctgtcataactgaaatttacctccttttcaaacttcgtaactttcattccttttcgttgcttaagtgaactgcataacttaagctctgctacaatgctgactggctgtggtgttagtggacatcttagtcttatttccaaactcatggagaaagcattcaggttttctacaatacatatgatgttatcaatagtttgtttttgtcaatgcccaggctggtctcaaacttccgggctcaagcgaccctcttgtctcagcttcctaaggtgctgggattacaggcatgagccaccacacccggcctgtaagtaaagtttcattggagcacggccatactcattcatgtatgtatcatctatggctgcttttgagttattatggcagattgaggagttgcttatagagaccctgtagtccatcaaggcaaaaatatttacaatctggacttttagaaaaatagttggatgactcttgatttatcacatgtccaaggtgagaggcataaggctgcttattagagcactgtttcatagtaaaaaaaaaaaaaaagcaagaacagttttaaattctcattaataagggagtagacaactggactgtggaatattcaatcacagagaaattctgtacagcagttaaagtgactgagccatgtttcaacactgacaaatttcaaaagaatgactaaaagaaaattccattgatataaaataactataaaacactttaagtaaacttttaaacacacaaataatacagtatgtatttttctgagacatgtatccatttcactgcctttagtctccacgtgtagtatgtatttcatgtttacaaataccatgcccccactgaattgcacgtctgtgggagggctcagtatcacctaaagtggacccctcccaaattgtgattcaggaagaagcagtgcagtgtagtgattcaatgcataaccctagagatgagctgcctccattagaaaattggctctgccactttgtagtcctgtgactttaggcaatttactcttgggcctcagtttcctaatctgagaatagaaaccaaggcttctctctctaaactcagataacattagaatggaaggactggacaaaggtcatctagttgatttgcatggatatttcctgggggcctaaggattccttgaaaaacctcagatgttctttatgtctgcagattaagagacacaagaggtatcctaaggggcatacgtgtacatgtgtgtacgattccgcctctacgccaggagaagtaatgctactgaacactttatatatttgacttccacacactcatttatttgaatgttttaggaaatctctttctgacttggctgtctcttttctctcttgtctgtcatcattctaccaatgccctgtgttcctccaaactacatggtttaatgagctttttcttctatcaaagtacagtatgcatgtagaaaatatacacaccatgaggtagggctagaaggattttcacaagctaaacacccccatgtaatcttcatttgagtaaagaatagtataaccttagaagtttccttcatgctccttcccagtctctgatcttctcccaaaataattgttatcctgacttctaacatcattgattacttttgccttttcaaattcttacagacatttaatatgaataaattgtttatctgctttatcgtatctgtcacgttctgctcaatattatgtttatgagactcatcagtgttatagtgcgtggcattattttattcattttcactactgtatggtactcctttttatgactgtcaatttatgtatctattatgctatttaagtacatttttattgtttacattgttggctattacaaacaatgctcatgtaaacattcttgtatatggcctttaataaacacaggtataaacttttgttaggaatatattagaaatggaattgatgagttcttgatgttttgctaatgtcaattttaataaattctactacactcttcctcaaggtgttgttaccaacttaccctcctaccaaaaaatggatgagagttccaattactacataaccttgcccacatttggtattgtggttctttttaacttttgcccttctgttagatatttagtggtattctatcctcaatgtgggcaactccctccaaagaaacaaaaaggaacacccctcacccacaattttcacactgtagcttgccttttcattcccttaccggtcttagcttgctaaacagaggtttgtaattttaatgaagtttaattttaaaatgatttttcttatatttagtgcttttcaagttctgtttaagaagtctttgcctacaccaggataattaagatattttcttatgttaacttctagaagctttatcattctataatttacatttagatctatgattcatctgaaattgactttttgcataatatgaggtaggtgtagagattttttttcaaaatatatatttccaatagccctgtgccagtttttgaaaggagtgtccttttccctgtgatttgcagtaccatcttttccttcaatatagccatctacgtgtgtctattcttgactctcttctattctatttgtgcatttttcttccttacaccacaccagatggtctttattgctataactttatcataaatcttgaaatccagagttgagttcctcagctttgaattttctccttaaagaatgcgcggctgacttactgttcactatccctcctgctgacaataggaggaaaatcttgacaaaatagcaagaaaataactctttgaatataatggacagcaaccaacacagagagtactaaagaaaaaaaatcacagaataaccttggtttatttcctcaaagcatttctcaattccctgcatggggaaatagccccagtagacattaagagctattccaagctgtggaagcaaaggtaggtggccaaaattattgaaatctgaggggcaaaaacagaggaaaactcagaagtgagcctccaaatatgcatataaatattctttatatcttttgtatttacccacttatttatggtattagtccattctcacactgctataaagaaatacccaagactgggcaatttataaaaaaagaggtttaatttactcacagttccacatggctggggaggcctcaggaaacttagaattgtgatggaatgtgcctcttcacagggcagcaggagaaagaagtgcctagagaaggaggaagagcttgttataaaaccatcggatcccatgtgaactcactcacgatcacaagaacatcttgggggaaattctcttgaattgtaatccccataattcccacgtgtcaattacctccatctggtctctccttgacacgtgggaattatggggattacaattcaagatgagatttgtgtggggacacaaagcctaaccatatcatttatcattgcaggtatttgtcattacctctaaatttttgtttgatatgatttcccttcattctaaaaaattctttttatatttctcttagtgctggtatactggcaatggattctctcagattttgtttatctgaaactcattttattcacatttcaaacaatatttttacttaaaaaaatactattcttatggaaaatagaaattctgagtggtagttcttttcttaaacactttagaaatgccattccattgtcctctggacatcactgttttttattagaagtcatcactcattcaaaccattgttcccctgtctatatcttgatttctggctgcttttaagatattttgcttatctttgaatttcagtaatttgcttatgctgtgcctagatatggctacctttacgtttatctggctctgggtttgctgcaatttttggatctgggttgataattggatcatctttttcaattagtttttggatcattggtgctggcacagcaaatgttatgtatgttagagtgcttgatgtccttcaggtgactgcagtttttgtttgtttgttttttttttttggggtatcagattctcttcttcagattgggaaatttttaatattttatctttaattttcattgtcctttcttatataatctccattctgctataaagttctggtggatttttattttagatggtgtccttaaaagaactgtgttcatgcttggctttaatagatactaccaaatgctttcctaaagggtttacatcaatttatactctcctttatcaatttgcactctcaccagaaatgtgtgacagttacatatgtttcacatccttgctaacacttggtattgtcagtcttttcatttaggcaattctgatgcatgtgtgtagcagcagcacattgtaactaatgatatttatatacatattcagatttatgttcacattcattctgtatcaatttctacatatttttgtcattttagaatctagcctaagtataaattgttagaaaaccatcaaaagacatttgatattcatgcaaactaaagttgtaaataaggtggtaaatagggagcagtattaaacataagtgtatgttgttctataagtaagcaatagtccatttctaagggtaggagttgttttgtagaacagcaggaaaaaacaaaagtcagaaactgctccaacttatgacatgcaataaatgaaacaatctcagcagtagactcagaaggtacagtggaaagaatgagacataagaaggcacaatggaaaaaaatggtcttatcaagttctagacattcatttgatattttataatatatttaattactatgctaagatttctcatctgtttacttgttgacttttcttttactttcttgaacattcttatagctgttttaaaatcactgtctgctaattccaatatctaggttatattaaaatctgtttctactacttatttgtgtcttctgatcatgggtgatatggtttggaggtttgtcccctccaagtctcatgttgaaatatgattcccaatgttggaggtgggacctagtgggaggggttgggtgatggaggtggatcatgaatggctctgtgccttccctgcagtaatgagtgagttattactctattacttcaccctagagctggtcgtttaaaggagcctggtgccccctcctacctctctcttgctccctctcttgccttgtggtgtgtttgctccccattcaccttcctccatgattggaagcttcctgagatccttactgaaagcaaatgctggtgccatgctttttgtatatcttgcagaactgtgagccgaacaaacctcttttctttataaattagccagcctcaggtgttcctttatagtgatgcaaaatggactaagaccatggcataattttctgctttttagattatctaattattgttgattttgtacattacacatttttgatgacattgtaaagagtctggctactattgtcttctttaaagagtattaaaatttctctcttaggcagttaattactggtagatcctcttagtactgttgggctcagcttaattatttcttaaagcttgtcctcttttgtcctaaatcacagcctaagcatacagccttactctgggctgtatgtagccctttctcttaaactgtggcgtttctgaggtcttaattgaatggccaagggtctcagtgaggtttctcccctctgactggataggacttcttatctcccagcactgtggtgtcctcattcaaatcttgatcccatacagcactctttgctggcctcacagagatttacctgtgattaataacctagttctcagacaagaacctatgtaaaacctcactcggacgtctaagactcctttgtgtccaactgcctcctctatggagtcctgataagctccagtcattcctgtatctctgaactccagtttgtgcttactccgctcagcaaaaccactgtgctctgtttgtcctccgtgcactgtggtttagaaggtatctactcactaaaagcttgggtaagcactgggcttttatgtttccctttactcaacaaaaaatcttacactgcctgttgtccagtgcttgaaagagttgcttcatttttttcccccagctttacaaattgtttacagtggagggacaaatacagtactagttactgagtcatgaccagaatttgaaattccctgtttggataaccagtttatacaagcctgaatagagttggagtgtactttctccatttccattttctggaataatttttaaaatgtaaaaattgtttattattttaggaataatataaatcttttggtaaaattacatagattcagtaatttttaggtagattttgattatttatttgattaaatcattatatttcatgattattggcctattaagatttctatttccttataagtcattttcagtaaattataaggaaattatagatttcatctgaggctacaaatttattgacatgtgagcacattttaaatacattaaacctgttacaaatcaatataaaccaattatataaatggtaaagaatatggacaggcagttcagagataaatgactattgaaaatgttttaaaattttatctactttcataaaacaaaataaagataccttttttattgaccagattgtaaaaaaagttatataagctactaggtaagtaaacatgtggttaaccaggcattcatactctattggtaagagacaatattgccctagaatctgtcaagagaattttggtaagaattttcaaaatctgaaatattcacactctttgacttagcaattccacttgtagaaattgattctgtaatagacatatatataaggatatttattgaattgttatttaaataaaagagtctattcatacagataaaaacatgcaactactagaaaggtaataaatttataaatgatgatatatagaggtctcatatatatatataaatgaaaataaaataaaaatgaaacaaacaaaaacaacacacacacacacacacacacacacaccccccacacacacagtgcagagccatgagtatagtagtatctcactggaataaaaacgtactaaaacacacacacatatacctgaggaactggtatcagagagtacctctgaagaaggaattggggaactgagatcataggataattttttaaactgtatgcccttttgtactagtaagtttttttgacatgtgagtcagaacctatctactacattaagtgagcacttactgcgtagaggatttgaatgtgtggttaccaagagttactctaaacaaaagagctggacgagatttgacaggaaaggcaaaaaataaataaggaaagaattctgtcctctggccattcttaatgtaacagagaaaaataaggcataacaaattaagtaaaaagtcatttttgtttattgtgtatgtattactggaaaatagtaaaaaattgcatgatgtgttttagctatttagaatgatttattgaacaggagatgtaaagccaagattccaaattgacagataactattaaatcacttaaaaatcaaaaggataaaatgctccactaagcactgctgaaatacaacaatctgattcttgtctagaaacctgtatgagcacatgaaaaaattgccatagcattttgacaattgcataattgccctgctcagatcacttccacaaactctaatttctcttaattaaaatctaaattctttaaactaacttattatcttctcaaatctacatccaacttgtttttgtttctccctcttcctacctgtatgcttctaaaattttattatttacagtttttaaaacgttccactctcatttccaccactccactttctttcatgttattttgtgacatggattttttttgtcttgcactctgttaaaagctttctcaaattccttctgttaatacttgatttatactacttccactacaataaacaaaaacgactttatacttaattcgtgtatgtcttattttctctatattacattataaatagctggaggacagaattctttcttgatccatttttgccttccccatggaaaccagtccagtttcgcgtgctcagcagctctcagtaaccacacattcaaatcctctatatactaagtcctcacttcatctcagccattggttcatggaaaccgcgacctgaagcgaaacgaatgtaactaaaccaattttcccataggcttatataaagaagacttaaattcctagggcgtatttcttttccttttttcttaaatttaattttaagttccgggatacatgtgcagaacgtgcaggtttgttacgtaggtaaacatgtgccacggtggtttgctgcacctctcaacccatcgcctaggtattaagccccgcatgcattcgctatttatcccgattttctccctaccctcgtcctcccgacagacccagtgtgtgttcccttccctgcgttcctggggcatatgtctagtcacaaaacatcaccaacttatgcataaagactaaaacacttccagtattaaacattgaaatatgtgtgagctaaatgtactattaagatagagtcaaaaaacagagaattatttacgcaatttttggtgaatcggtaagtgatggcagtcgtagtggtggtgggtaaaatcaaagaataagtgtgtttgcaaagcattttaaaattccagttcagggtctagagtggccagagcctatccctatagctttggactcccagcaggcaccagcctggcctgaacaccctcccatcactggtgattcacatgcacactcacacactcacacccacattcacccacacacccacacccacactcacacactcacacttgctcacactcacccactcaaccacactcgctcacacttatccactcacactctcaccctcactcacccccacacactcacacccacacttgcccacactcatccacactcacactcacccacacttacctacacccacctcacactcacactcacactggggccatggaggatcaactcacaggtacagctttgggatgtgggaggaacccagaatgtatggagaaaacccacacagacgtggggagaacacacactccacacagacagggtccccaatgggaattcatttttttctcctcaattttagaacacagcgttgaatgaaatgttattcgaggacctgctatatataagattgacacttgggatagcagtgcttagtcatatatgaaggacaggaaggagcccattgtgcctgaaaagtaggaaataagccagacaatggaagatgtggttggaaaagtagcaacgcctggattacagggggcatgtcaccttggtaaagaatatggattcttatttacctgtatggtaatagtattggaaactattaatctgtccctgacaatctgctttgtgtttggttgttgtgtagagagaatgcactgaaggaggtgaagctgaaatgaaagcctggagaccaacatgaagttgatgcattaatacaaacaagagaacagtgacctggactaaacaagtagcagtaaagaagggagaagtggccgggcacggtggctcaagcctgtaatcccagcactttgggaggccgaggcaggcagattacctgaggtcgagagttcgagaccatcctggccaacatagtgaaaccacgtctctactaaaaatacaaaaattagccaggcatggtggtgcgtgcctgtaatcccagctacttgggaggctcaggcaggagaatcgcttgaacctaggaagcagaggttgcagtgagccgagatcgcaccattgcacagcctgggcaacaaaagcaaaactctgtctcaaaaaataaaaataaataaaaataaaagagaaagaagtgctccgattctggatatatttcagatgtagaatgcaaaggacttgctgatggattagaagtgggtggagagaaaaaggaggtgccaatgatgctcctagaatttgggtttgggcttctgggtggacagtggtgccatttactgagatggtgaaaagtcaggaagaaggtggccgtggcagatgagtggtcaagtcaagtttgaatttagaccaaatagaggtgccactgaaatatcaggagagaaggtaaggctaaggaatcataggctaaggaaacatctgggcattaaaagtcatagttatgggggagacagttaggcttagttatgcttaagaacagaagacaaaaaagagggcctgagactgagcttgccctgggagaggattatgttagaaaatgcaagcggagaaggtattttaaaagaaaaacagtacacgttccatccaatactggagggcagttgaaatcaggacagagaaaagatcactggatttggcaacatggaaatcaggtgatgatgatatgagtcctttcaatggggtagagagggcagaagctgacttgaatgggctaagaagggacatggagaggagagacagtagatagcagatacagacaagaattttgacacatttgcttttgaaaggaaacagagaaatgaggcagaggctagaccaggatttggtgtgaatagaatttttaaggtgggagactcacacacaatccagtattaaagggcttatttaatagaataggaggataatcaagaggggaaaacatacttcaatcatgcaattttgatggcttcagaaagagtggccctaccagcctgaaaatgtgtgaagaaaggcaatgaaagcctcatggtcatttgaccgaattttgccctcagaagtgtaaagtcattccctttgaatctattatagtgagacctctcagtgtttcaaattgttgtcaagctcctcaatttttaccaacaaacttgagatcaaggatctaatcttaggaaacacctacagacacagagggagttaaaggaggaatcacaaagagtaagactagctttaaggagaggagagggtcattaaattctgtctagggcagcgtacagatggcaggagaaatgctcttgactttgatctagaaaagatcacaggtttcagtaaatttggggaagatggaaaccaaattgcagaggaaagtgcatagtgagtaggaagaaaccatctgttcaaagaaatgttgtcaccatatgtaggagagagatggcatggcagaaggcaggggaagcaaagtcaatcaatcattgtcaccaaacaggcacacactggagtaaacaggtagacttgctggtatactgagaatattgctgctcaaggcacgtgttcataaaggcactttttacatcacatggagttagaaagccggttctaggagtaggtgaaaacatcctaacagcttttctcatcataaatcataataatttagaaagcaagaagacaagataaagataaattgggcataatgaaaatagaatttagctgtgaatcaggagttttgagttctactacaaaggaaggatttcctgtaggcttgagtttcttatctatagataggatacaagaatggttcagattaaaccactttgaaggtctaattgagatctaaaatgccatgattctaaaataattgcatttcaatttggaaagtgggtccaaagatagggaaaaaatctgaaggaatcagcagaagcaagcatggagatccacattgaatctcccaagccagaagaggaactgcaacccataggcattgtttgttgcctaaagatatgtgacatgtagataagtcagaacagagtaccttaattcttaatttatattgggtacagaatctgtgagtggaaccacatacactgtttttcctgtagtccctgtgattgccttatgattggtagcatgtgtggattagcataaagagatttattttttgagaacctggagacattatcagattatttaatacctccttgattgatgctgaaaccagataatggcaacctggtatttgtccctacccaaatcttactcaagtgcttttcaatataatctttgtaatcttagcaaagagttacaataaagatcaagctaacacctgacaactgttcaacatttgatttgttttttaaatacaaagcaaacattcagattgaattattgccttaatccacacggatcactttagtcctggataaactagatggaagtcagtaatactcaatactgtagctctaaaaagatgttgccaacccaatatttaataatatacctttcagactgccaaccatttttcatgcatgagctttgaaaaagcagtttccaacttgcggatcctttagtcatttcgtaaaggtcatgaggaagaatgtggcagacagagattaagtgtttgtcctggagtctctcattgatggaaaagcgaaattccctaggagctattttgactccaaggtaggtttctagcaactatagtggagctagctgcacgtagccccaagcaggccaattaattgtcaaaacccagaagggagtgtgcaaagggaactattagaaaggaaacccctcaattttcacatcctaatcacagcagtctgatctctagaaagacctctataaaagcagttttgtgtttctctagatcctttcaggcaaataaccctagggctctgatttctgcatcgacatttctttggccaccgtgaactgtgcagccctttgacaagcccaagtacagttgcactgtttttcataaaatcagctttcatttgtaaagcacaatgtaaatgtcagaaatgggaaatttttaggacaaaacaggtcacagtcttccaacttttcccacacagcagagattttccctaattgtgttcaagtgcctacctgaacaaaaaggaacacttcatttcactctgtgacagtggctgtggggttactatcatgctctgggaattaaagaaaagaaattagagcgctctgctcttttatcacctcctgagagttggcctcatggctagagtaaacttggccttgaaatggagttcaaataacttaaggaacagaggtatcatggtattaagcacctgtaggaaagcaacatatggcaaaatggtgcataggttggtgataagtattgtaggagtcatatatctcaagagaggatggcctgatttgatgactttcacatcattctctgggttcatcataaatatacaagccatgtttgtttatgagaaagtttgtttgttatgcagattggcactagttttatattttaaaaagttctctacaattattccaatcaagtttaaactttcagagagaccattgttaaggctagatttattccttctcttcctttttttgttgggacatagctcaacttagttctctttcagaacacaaatttataataatcaaattttaaaaggttttaatgtttttattatataattcatgatgaataatgattaaatttatggcaagagaaattggaaattgatcatgcatatgctgacatttttagtcaattgaatcatatacgttaggctgggtctgtccactatatatcataaaatactcacacatttatgacgggcaaggctttcaaaatttaccatatcccagaaaaccaagccaaaattgagcatatgtttttcttttaattatcacttaataataattctgggccttatttttaaagagcattggcaggataacttggcgtaggaatcgacatgctttgttgactggcaagttcttgctagcgtctttcctgcattgctgtgtttccttaaacaaatctatcagtatttgcagaattagatcaattggagctggaaacatcttcctggatgatggagcctttcctctgactcacaaccagttgctgtgtgcagcttctcctgtacactttggcctagttttaccacagtaagaaaaacgtatgtgactccactttcagtttccaacgctcatgtctgcccaggattccctaattaacagttgactatttttaactttttgcgttttgtgtcttaccatgtagttttcaaaattggttctggtaaagtcacatctggtacctttagttgccttttggtttctagactcactttctccactgtgaaatctgcatgtgctggtactgctggcagctcctccaacagacctgctgaaatagctgcagaatcctttaggacaggaaaggaagttgcccgaattattttctagagcaaagtaagttagaaaatgtgtaaacaggtaaagctttgtcacctataaggtgaaccaaagttgtggggttcatctctcctctgctgtccttcccttcctcacccagcctccttctcctcatattaatgtcacattgaaatctgtgctacttgcaggaacttgaacttctgtctcaagcatctttggacacattcttttctttcttcctgaagtggtcttccctctatagccttcaaattcatgtgttaatttacccttaaatttattttccttctctccttttttagccatatttcttttatttatgtttcttgctgtgtatatgcatagatacacacatatatgctgtatgtgtatatataatataagctacttcatttcctctttacaaggcaaatatgcaatatgaaaagataccacacaggatattaagcattggtgaactgctgccctgaagttatttatactccatttggagaaagtcttaaaaaattatctactaaaaattctgcagtacagatttagaagtgaagtatattcaggcccagaggtaacaaaaaagtgagaataatcatttctgcacatggacagggagaaatgtgttgctagaacactacaaaagtgatgctatttgcatcttgaatcttcaagaataagaaagaacatcagagaaaaatgggaccttgttatttagcttggttctgtattcaagtgcaatgacattgagcctttctttccttcattttttcctgctgcagaatgctagttatgtcttatcccctagatctacataggtgaatctgatcagattataataattgccacaaaaatatcatgtggatatatgctctggggttgtacaatactcttgctgaaacaatacagataaaaactggttaaaataaattatgagggttatttgatgaagaataggtattatataacgggtctttatgaaaaaaactgctcttatagtttctcctttgtgacaatatatgcagatttgaggatgatatttttaatgtgtaatgatcagtcctttgtcataccagttagtggccctacctccttctttgtaatcagctactattctaaaagactgcatgtcagtaaataatctgttaatgcaatagcctcaacttctcaaattctaaatatgatttggtaatcacatatcacataaagattttatgagagaattggaaaagaaaaatccgtcatggataatcggtgtggtcttttggctaacactttatactgtgcttgcggcttgtactttttcatattttgaattcattaattgtgcatttctttttcccctgttagattataagcaccccgtgggcagggactgctaggttcttgatatctacacaaggctcagtaagcattgagctgaatggagaggctggcccagctagaaagcatacagattatgctgatggtgccagctggatggaattgaactgaggaaattagcattgattctagaattagaaccacctcctctcagtctgccatgtagccaaatcttaaaccaagggttattttgattttttaaaaaatcgcattacttaagtttactaggtagaagattttctgaattggaaccatgtttttcatatttttcctgtgcaaataattctcagttgataatgtaattagacataacccagctaatttctttggtattcctaacatttaattagcatgttgttcttattcattaatactgtggtgatattttcagtgctattcttgagcattcaaggtggtatcaaagaaatgatttttcatgacatgaccaccatgctatttggaagaaggaatgtttgtgcttgaatacaccatgcctgcgagagtagactgcctctgtgtccagccatccccacaggggagacgcctcgcagtggcgagaatcctgatacagacctacagggaatgactggcattggctgctttcgattctgctgtgattgctgatgtcccctgcggttcaaaggataattcagtttcaccaagtgttctcttgttttggactccatggtggagccaccaattttgctatctcataggaaattatttttgtgaggcctcttttattggttatccagcctctctctgaagcccgttcaccctcagagcatctggaaggagacaggacaaatacagtttgagaaaaaagaggatatgatatagggagaattccttctacactggaaagaaaaaaaaatggaaaatctgccccttacactctggtggtgatgaggaagagaaacaagaaaggaaaagaaaattggaaaaagaaaagtggacagacatgtttatgtctcagtccactcttctgggatgaaacggagggagtgtgggaagatgttagatcctttgaagggaaggctgaagtcagagacatggaaagaacccagaagcagaaggtccctgagctgagggcaacaggtctggcacagaagcatcctcaggagagacccactgctgggtacagagccctggaggaggcaccctgaggatagggcggagactcggaggcatctacagcaccagatgccaaagacaggccacaatgcttcactgagtgcttcacggagtaaatagaacaaggaacaattcaccaggtactttggagcaaagacgagtgaagatgcaggtaaaactccttgacttaagctccttttccccctttgctcgtagggcattagatgtcctcttcattcacctggatgtcaccctgtggaggagctgagtgcgttgtgcatgtccacttaacgtttgcacgcatgtgtgcagatacgtgtgctatgtatatgctggtggagggtggcatgggctgtcatccaatagaaggggcttttacctggaacagttgaagttaatgaacaattactaattaaatactactgctgggcaccgtggctcatgcctgtaatcccaggactttgagaggcctaggcgggcagattacttgaggtcaggagtttgagaccagcctggccaacacggcaaaaccccatctctacaaaaatacaaaaattagctgggtgtgatggcggcatctgtaatcccagctactggggaggctgaggcagaagaatcgcttgaacccgggaggtggagtttgcagtgagccaagatcgcgccactggactccagcctgggtgacagagggagacttcatctcaataaataaataaataaataccagaagaatggcagatactgtgaatggttgtattagtcggagttctccagagaaacagaaccagtaggatacagagagagatgtgtaagaggggatttattatgggaattagttcatgcaattatggaggccaagaaatcccacagcatactgtcttcaagctggagatcaggaaagtgaaatttagtttgagtctaaaggctaaactcagacagccaggagcagccatgtctaagggcgggagagacagttgacccagatccagatgagagagtgaatttgctcttcctcctttttttcactctatccaggccctcaataaatgggctgatgcccagccatgttgatgaaagtggatctcctttactcagtctctcaaactgattgcttatgtcttccagaaacatcctcaaagacacacccagaaatactatttttccagttatctgggtatcctataaccgtatcatgttgacatttaaaattaaccatcacaatgtaccaggaaaggtagacctctgttctactctctagttggatgatgctggagggaatattaggacctgttgtagagtataaagaaagaacattttatttgcaaatatgcataattgtagttgacaccctgctacccataggttaaatacacaatttattctgggaaagaagagtaaaactatattaaaagttttaaatgtgctgctttctaatcatggaatacattatttttgccacttccattcaattatctgtcatggtattcatgttctctccatactagtcattataggatctcggccaagcacggtggctcacacctgtaatcctagcactttgggaggctgaggcgggcggatcacgaggtcaggagatgaagaccatcctggccaacatggtgaaaccccgtctctactgaaaatacaaaaattagctgggcgtggtggtggcgggcgcctgtaatcccagctacttgggaggctgaggcaggagaatcacttgaactcgggaggtggaggttgcagtgagctgagatctcgccacggcactccagcctggcgacacagcgagactccgtctcaaaaaaaaaaaaaacaacaacaaaaaaaaaaaaaaaaaagaagaagaagaaattgtctttataggttttctctaaatagccattaatgtctgaaaaggagatgaagagcttctctctgtgacaaagttttgttttacactggctgtgcttttgcagatccagcttctctcgccaaatttggtcctccttaaggatctattgcacgtggaagaagacaagttgaatccgacaaagttcttttgctcaagagtgatatgccctattaagggagataacagggacacaggtaaatctgtaagtcagcagtagaacagtgtgtgacaactgccatgtaagtggagcaaatggggcatatgcctcagacaagggaggctgagtcttactgcgtttatttttacttaacttatattgcaagcattacgtctgtatacagtggggaaagaaataaatgatgaaggaagacttgtaagtctttaggaacttagcgttctaacagtccctcacacctctaatcccagcacttcgggagcccgaggtgggtggattgcatgagtccaggagttcaagaccagcctgggcaacatggtgaaactccatctctacaaacaattaactgggcatggtggcgtgcacctgtggtcccagctacctgggaggctgaggtgggaggatcacctgagcccaggaggccaaggttgccatgaatgctaatgcatgccagcctgaatgacagagggagatcctgtctcaaaaaaataaaaggaattagtaaaaagaaaatattttggcttcacggtgatagctatagggaaactaggttttcccagtctttctagatagtatttgatcctatatgctccagaatccacgggctttgactttgactttcttttgtcttctttccattcctaccgacctactcacatagctccttagttatgtcagaccagcaatgtctctgggtcacctcttcggacaaaaccatattattgcttatgtttgaagcagcatcaaagtcaccagcttctctcaaagaagaaggtgacatgtgactatgatccctgatggctggatttttgatgccaggatccctgtagtcagaaacttcttatttttggaacactatatggctatttcaagtggaggctcagttctttctgggagttgtactacgcagcattttcttgtgtgagaaaggaagctaatccccttggggcggctgtggggctaataacctcgttgttataactaatctactttaaagtataattcttcaaagatgcgttttacaatttttaaagcatattattttcacagttgaagcactcagaggaaaggggtattcagggtattttgaagagattagacacgtattttttcacgacatttttcccccatgattttgtagcctctccctacagaaaggaataaaaagacgtttctctttgttccccctgttcctgctcttgtaattggacttggagttcttgcggaagggaaagagattgaagatgcaccaatgatttgctaatcaatagttatatatatatatatatatatatatatatatatatatatatatatttccattctaaatgtgcagtgctctgtaactgaacccacatcttggctcaatgcccagtggaaatttcaggaacaagggacagtgtgtctcagtccattgtttcaaataactctccttggcttctttagggggatgaaacaggcattcacattaggccagaaggttattagatctccacgagatgctgcccaggtctggctgcacaccgtgaatattattctgtcaacgcaaatgtccttagaatctgctagaattgaatgactcttagcagctttacagctgtcttacaacatttgacatctcccaaaaaacgcttcttggcaccaatgagaattagtcactgggctgatttatatctaaaaagtatggaaaatgaagtgggataacagtatcactgtttccatgtatcatgtttataaaataagtattgtgttttccccccgaaggctgggattgattttttacgccacccacagccatcccccaacttttatagcccgggcaactataaataagtttaggaaaattactcctctacggtttcacaaagcatttcttatctgactgccacagctgtcactgatccaaatgctcttatttgggatgtctacggctggaaatattattgcttatgttcttcaggggctaaagaacgttatcatattattttgtgaatttaattcatttctcctgtttgtgtcaggggtttttaatgtctagtgatttctcaaacataccaaaatagatgatcttcagcctcttctatgttgttcccttttctactgttaatgtttatttataaactaaatttctgattttaagggacgactttgagcttcataatttacttattatatttcaatattcctaatgtgaacccagaaactaattatcatcctgttcaatactattaatagtaataaattcttcaaggtagttattcgggctttcaaaatattaaactataaatatttctaccagttcttctttatgttcttctgtttgttttctttaaaattagatgtctttaaaatgtgcatagacaatgaaatattgcctagaacaaaacacaatggtatccacttgaaaacctgtaggatttaagacattgtatgcagttaattctgcatgccaatatttcctttactataattcagttttctccttagttgatactatttattccatctgagagcccttgttatttaaggtgtatattttgaaattgaataaaaaagaatatagtcaaatactatttagggtacaataattaatattttataatatgttattcaagatccagaaagatctacacaaatacaaatttcattaaatattatttctcatatatgtaatcaattctgtttttattttttgaagatgtgacttttggttttctagtatactttgatgacattctgaaataaataaaaatcatttttaacattatttttcccttgttacaagtcttaaaattaggtaaaattgaactcagacttgtcacagggatgaagaaagactatttgtaaagtctttggaagaaaaggcagaatttcatttgaagcaccccaaggtttctgcttcaaacaatttcccccaaattacttgcctgagaaatacatcagctattaagtaaatgtcaaatattggagaaaaagtcaaaattattttgcaaacaccgaaagtcatggtgaaaaatatgacagatcttataatgggcaggaatgtattttacatgcatttttcacaactctctaaagactgaaaaaaaaaaaaagcccacagagtcagatagaaagaaatagaaagcccagcaattaatttgaggatttgatcaaaatagacgtcaatgtacataccttcagccaaacttttcattttttccacaatagtactattctttaactaagttcttttctccctctgaattgtcagaataattttttcaactcaagcctttcccaactgcagattaaccgtggattatttccagtacctacctacctaaactttttctgagtatctcagtgtcatgttgtgattggtttaaaatgacttcttctttttctattcacatcaaaccggggaacaatatgatcaagcatctttcaaaatagaaaattgctggtattgctagagacaatcgtgttcatattgcaggatcatgttaatattgcaggaagtctttggatgagttctgaaaagtcaggaaggaatcacaagaataggtgctgcaaagggagcatcaccaaatgaaacttttctttctttggatcaagaggccttggtttaaaattagctagtgattacagaagtaatcaagtcaaataaaaggttgagacaataaaattcaattagatttcatactaaaggtaatgggaagctactggaaggtctatactaaaacaatggaaagagaatttaaggagatggtttttacaagacaaattagaaaggatgataccaagggtagaaatagactgaaagtactgccatgatccaggcatggagtgcttggtgctcaggctgtggcaatagctgtgtaaaagcagaggaagagatgaatctcagagacatttaaaaaggaaatacctatagaagctggagatgaagtttttttttcttctctttacctaggaactgagacgcctgggaaatggtatcattgacagccaaggatggttaagcattttttgatgttccaactttgtatttatgcaacaaataattggaaagtatctgtgtgccagggtctaggtgagggcaataggagtaattaaaaacaatgaatgtggcattgttcgtgccgtgaaggagctcagtatgtgtgggacttacaagcctatgaaaatagaaatattcgcatccaagtgcctctagaacacagtactctgtttattcttaaaaatatatatcctaaggtttaataaggcagaagaattttaaaattatctcggttgttttgctttaatagtaatcattgtttcaagaactaaaagttgcaatgaaattcctaaaaagagatatgaatataaaatcaaaaacttaaaaccctgtaatgttaaattaagttgaaagtactgtcatccaaaagaccatcaggatggtgaaataatagaaaagagagttttatcggtgatgtcagcttcaaactgtctcaagagagagaatctgcagcatggacccaggctgctctctttgaagagggaaagggcaggttgggttttatgcctcacagggcctgtaccacacaatagagtcagagatattcggcaggtttggggataagttatacatgtcgatgagggcagctggaaaggcaaaaacatgcacgaagggtaagtagatatgtaacatacatcccatgttcactttggggctgggttttagcatgaaaatgagatggaatttggctctttatgttaaaaagatgcatgacaggacaggaagacaatttgcacacagtctctacaagctggctgaaactgccttaagatctgcagttgtttatcagaaaagaatgtgtgtaacgccggacctctgtctaatcagtgttgtagccatctgggttataaatcggagttaggaatttgcctgatgtctcctgttgttaaggagtaagagggtggtttatagctgtaggaatttaggaagttgccaggccagccaagccctgaaccctcgacccataggtaacttttgttttcttaaacttagggcccgtcttagttgatagatgtctattttgatctctcaaattgcaataccaaattataattttgaaagttaaattttctagccctccatattgaaaaagcccaaaaacaacaataatgcttcgtgtaggaatcagcacttctcacacacatgtttcgtttgtttggttttatgttgttattgttttcttttacagacagggcctcactctgtctctcagggtgaagtgcagtggtatcatcatggctcactgcagcctggaactcctgggctcaagtgacctgcccatctcagcctccaaagtggctgggactacagctgcatgcccccacatctggctaatttttaataaatttttgtgaagactgggtttcactgtgttgcccagactggtctcaaactcctggccttaagtgatcctcccaaagcactggaattaaaggcgggaaccactgtgcccagcctcgtattttgtttttaaattatcattccacactgaaggaagcagggcccattagggagtaggtgattcttgatggagaaatagggagacagagatgggggtggggccagctgagtcttatacatcatgagtgtcttaaataccacgagaaaggaaagtctaggactcccgagattatgtaaaaaggacacagtggcagcctgacaggtcttcctgtagttcaaactaattccagcatcaacaacaacaataacaaaatagctataactcattgaaattcattacatacatacacatcattggtcaatggtaatgctaaaaaaagataatgtaatcaaacagataaataatataccaattctttatatgctttcttggtatattctttctgtactttgaaagttggtaattaaaagatgagaacaaaatattcattctgctttttaaataagaattttagtttcaaggttaaaaaaaggtgatcctaattgataaagaaagcttttatttgcagaagaatgccagttaaaaatgtaacaggaatagaattggataatcattttgctaatcataatgaaacaacttaaggaagaaacttagtggtgctaacatctttcataaaatgttgggaaacggaatattcacacaatgctgattatctctccacagactacttcatattttcagaggaggaaacatgtatttatagtggaaaggtctgactgtaacaaaattaatccagtattaccactaactaataggactccttagacattctgttaatgaaatgcaaccggaaacaccaattttctccatgaactattatattatgaaaatacaaccagacaaatacaggaaatagaacatcacacaatatctggctgatgtctttaaaaattaatagctcagggagaaaaaggatgtaaaaactatacttgacttaaaaagacaagtgacataacaaaaaaatgtattaaatgctttttgatcgaatcctgcttagaaaacaagagttaaaacagacattgaggaaacttgaatttgggccacgtatctggtattagggaattcctgctgattttgtggggtgggtacaataaagccatggcgatctcatgggagagcacttctgttcatactgaagaattcaggagaaagtgtcaggacatctggaagtaacttcaaatgatttagcaaacagataggaatagcaatataaatatggatattcatatagagtatagatctacaatatataccctactcatatagcgtacagatctacataagctaaatatcaataattgttgactctggatagtgagtatataggtttttttgtagtatattttttgttttcctgtttgttttaaaattactataataaaatttttttaaagaatgcatatgttcataatgccccagaaggtacttgggtaacaataaaaaagatacactggccccatggtctcaaggcctttgccctagagatgcaaataatctacttctgggaatgaaggtcaaagagataaaaatttaacttgggataattagtggttctaagggaaactccattattgcaaacactataataaatacctgtgaaatgaagagtatgcgactgttccaacatatatttttagggtttagagtgcttagatcctagaggatactcaactctggagattctctgggtgtgatttaagagtgggatggcccagattggacctatgatcctttccttgagctttcctggggccaggctgcccctgttgaagtcttccaggccagggaaggctgggatcctacctcccgatgcagatattgcaaggccaaagtaaaagcaccaattctcttgaaatttacttctgcttccaggacagcaggggagaacttccaaaggtctcagagactgggtcacactgtgccccacatcacagctccctggcatgtcaggtcatcctaataaatgcaatcagctcagtaacacctgggcactctgtaaataccctctcactgggaaattacatgagaaaaaacatcttgtccttaaacttccacctcgagtccaagttctgtaaatcagtcgtgcattcaacagcctctttttagccattccagtcttatgactgactctctgcttcctacttctttgaatatgaatttcagtgagaatcaattattttacaggaaaaatatttttcactaggcaggaaattcttttcatcttactaaagctggcacataatagtttagacatttccattctctaaagcagaaaacatctagtgcatggccattaccccaaccactaaagcataatgctcttgaggtagaatgtgctagtatttaggaaactcattaagtcagaaagtactcactgagcccctatagcctggaaagtacagcactgatcacttaaggaaatcatcaatatcagactaactccaggtccttagggagttgcaaatatttatgagagagaaggtaatcagcctaagatcagtcttccttgaatgtagccataaaatatttattttgctcatatagattttatgctttgtttctttaaaagctaaattctgaaagttaaaacaatgctgtttctgataatgctatggttgtactttctgatatcttttatttttagatactatgaatgaaatcttaccaagtgtcatatttagttactaaacaaactatgaataaaccatcagcatttccagcatgtggatgttagcattaaagagtaaattctgattcttttaggtcaaagctgttgaattgaggccatagtttcagaaaatggatcacgtagtctttatgtgtttcatttcaaattatgtctctatcaacctttactagatcatgtatattgaagcttccatacaatctccatttagtatccgctgtggtacaaatgtctgtgtcccccggtacttggccattttcacacagctataaagaactacctgaaactgggtaatttataaagaaaagaggttaattgactcacagtccgcatggctggggagacctcaggaaacttacaatcatggcagaaggcaaagaggaagcaagacacatcttacatggcagcaggagagagagagaaagcaaagtggtaagtgccacacacttttaagcaatcagatctcgtgagaactcactcactgtcatgagaacagcaagggggagactgcccccatgattcaatcacgcctctcccccaagacatggggattaaaattccagatgagatttgggtgtagacacagagtggaaccatattaccccctcaatttcatatactgtaatcctaactcctaggtggtggtattcgttgggagggctgtctagggggtaattaggtcatgagcacagacctgtcatgagtgggattagtgtccttataaatgaagccctggaaaagctctcttgcctcttccttctgccatgtgaagttagagtgagatggctgtctatttcatgctgggatcttaatcttgatcttccctgccttcagaactgtgagaaataaattcccactatttataagccatccagtctatggtattttgtggtagtagcccaaaggtggtacccatgtgatacttcataaataaaaagttgattatgccactcccctgttaaaatgctgttattgatttgtactgagaacaggattaaaaaaaaaacaacctcttcaatgtggcctctttaacgtggtttaccactgtggctgcaccgaaatcacacttgttcttacccctcactccagctacccaggttctctttagcaaagacaggctacagggtcttggcaggtcgtgttcgatccactgggaaggaaaaactcttttttccccagttagtgcctgcttatttattagctctcagctgagtaattcctttctcccttactcccttgccctgtgtgtgggcattgctctctcctcgaaggcctgcagtcatctccctgtgcctcatgcaaaaccaacctgcagcagtggccctggtgatggttcacagaagctcagtttgcgctagctggaaagtgacctcaggtggttcctataagcttggaagcagcgatacctctggggcttcaaggaagtgcctatcatcagagacatatttcccccaagtctgcctcttttatattttatgtcatttcccattttaacgcattcatattcctctgtatctctttcaggttaaattccagattccatatctgacccaatctattaggttggtgcaaaagattttgtcattaaaagtaatggcaaaaaccaagattacttttgcatcaacctaatacaaccttctgcaatatgtaatcaatctctcaactaatcaagttataagattaagctcagtgattttgagggagcctgctggaaatcctctaaagatgtttcaaatattatttttgtggctagttttgtattgttggtaataaaagtttttgagagactttccatttctaaacacaaatcaaatatctctaattcttctaggaaagagaccataaaatctcttgattataataaaattttgctctctcaatttctaatgagaaccatggtagtgaaaataattttgacatatagaaattgttttgatgttttaataactagttatctgtatagtgtctggcttccagaatttctttataaataattctgatgttgattagccatgtggttgctaaccttgttccaagtgcatcacaaattcaaattttacaaaaaattaggaggaattatgtgatccacatgaatcactgatgccccggggaaagttttcgatggaaacctcacaatgtgggagatttggagaagaaactgactacataaggtatctgcttttgaaaggaatagttctattttgggaaaatttttcatgccatagagaggatgttccataactcactgcagagacagaaaatcatgagagttcctttgtgtttctatcataagacagaagaatgtgtaccatccgcaacataaaccctaagtcctacactgggataacttccctgaagtcttggaacagcggttcataataattatagctgagcgaggggcaccctctgcttgaggcggagaaactaatactgaccttacagaccaggttctcttgttttgtgttgttgaaaggctttttgctaccatcattctccaccatgatgagaaattttagatctagttcataaatgcaattaatgatagaaatgagaacttattgttagattcagaatttctaaagtacctagtgagaacctagtaagaaacacaatcattcttgactgtgcatacagttaagatcgtctaatagtggagagaaacaaagatggaagggaaggagggagagagaagaggggaggggtagaggaggagggagagaaagggagtggagagagagagagagggagacaggagagaaattccttttgatccctgaatattatagaactaatgatattattaaaatttaattttaaatctgcgtgtgctttttttataagatgaaaggaaaattttgattaagtttcttaaagaagaattcaatgaaaatatataagatgaatgctctggactaattaaataaaataaatatatatgcaacagcacacacttctcaagggtcctaaaaggtattctgttacttaaaagcaaaatattcagtgatctgcatgtatttacagagtgaatagcttctttactgtggaagaatgtttgatttttttacattataagattttagaaattacaataacattttatacttctatgaatgttgacagtattttgttataatttcattaattattaaaaaaatcaactgactcataaattatgattcctaaataatagcagaacctatttttttcctactgggcatttacatttacttagtttcattcttgtaagttgactgttaatctccttctttgttctcttccaatttgtcattaaatattgggatcttcctttagggcatacaatcataaataagaggaaattctccctgaaatcaaaggaagcctgctggaagatgttcatttgtctgttgctggttctgacagattccttatacttgatgcttgtttacacatcggggttccccatgttaatacgtctgaaaagctcttttgatacaatcaattctgctgttatagaaatgaactgatcaaaagtatcttttaaaagacatcagtcatctggcatattatttcccttatggtttttcccattatgatttttaaatattctgagaaataaaaattgctttactatatgcatgctaccacatatttctatgtcactcttcattgagtgtgttaggtcctatattaagcattttgcattaagttctatttaattcttacgagaaccaagtatactgtgtattaacaggtcaatattacaaataaagaaacaaagtctcacaggtgcatttcagttacctgcatggccacaaaaccaggagtagtaatggagtcagcatttattctacattggtctgacttcagcaactgcattcttccaaataaagcagttaataataaaataatacaaataactggtaaaatatacttaaataattatctccatctatttaaataaaataatttacataaagtgcttggtacggtgtctaatataatcatataattaaaacaaaaagtggtcacaacttctatttgaacagttacaaaaactgggttttacagttgtatttaccagaaaaggtcaattgctataacaacacatccacaatctcaattatttaacaaaataaaggtttgattcttgcagccgttagagtccaatggctatcaacaaggtcagaatgaaggggggaggcttgccaagcagttactcagggacttaggttccttccacagagaggacctgaaatccttgaaaccctccactgaaagattctatcttttcccagcagatatggaatcacaggacatcttgcgagacattgtaggggtcaggcctgaaagtagtatatatcactcccactcatatcacattggatggaattcagttgtatggcctgccctagctgaaagcaaagctcagataccttgtgtaaacatagagctttgtgtctgccccagtaagcaaaatacatcatcctccaaatgagtggcgattggagttttggcagtgtagttgaaaccttagtgaatagaaattatgttagagataaaaaaaaaattcccccctttgagaagaaacttagtttcagcacccaaattacaaaatgaactaccaaagattatgcatttattttagcattataaatgtgtgttactagtttgatctcctttgcaatgccagggtaagctgagtgttttaattacaatggtaatttttgtagcacattttaataaaactgtagcgtttcataaatttcccaattatgacatcattctaaagcactatttaattcacacttaattaaattggaggattatgaaattcgagctcatttttaagaataaaaaactaattttcttaaaattatagacagtgacattcttgaaaggaagaaaaagactaatgatactatctcatatccaaatatactagaagcagcagttgaagaattgtcttcctggagcttggccaatgtatatgattcgtaagatacattaccacaccctgtttacaatccttggcctggattcaactggagactgccgattccttctgaaacagccagagacttgtggcaaccttattacaaatggcctcttttttttttcccacagaaacattttatcccctttttcccagtactatgactctgggaagagctttgtttcaagatggtggctgtttgaccattctaatgactaagctctcagaaaggagttctagaagggaatgtataactttactaccactgacatttttaactcaaatcacaaatttcattcatctaggcatttattctttcactccagagtatttttgtcttatcttctgtattagtccatttcacactcctgataaagacataaccaagactgagaggaaaaagaggtttaattggacttacagttccacatggctggggaggcctcagaatcatggcgggaggtgaaaggtatttcttacatggtggcggcaagagaaaatgaggaaaaagcaaaagcagaatcccctggtaaacccatcagatctcatgagacttattcactttcataagaatagcatgtgaaagacaggcctccatgatttaattacctcccactgagtcccttccacaacacatgggaattctgggagatacaattcaagttgagatttgggtggggtcacagccaaactatgtcattccacccctggcccctccaaatctcatgtcctcacatttcaaaaccaatcatgccttcccaacagtcccccaaagtcttaactcatttcagcattaacccaaaaggccacagtccaaagtctcatctgagacaaggcaagtcccttccgcctatgagcctgtaaaatcaaaagcaagctagttatttcctatgtacaatggcggtacaggtattgggtaaatacagccattccaaatgggagaaattggtcaaaacaaaggagttacaaggcacatgcaagtccaaaatccagcagggcagtcaaatttcaaagccctaaatggttctcctttgactacaggtctcccatccaggtcatgctgatgcaatgggtaggttcccatggccttgagctgctccgcccctgtggtttcacagggtacagctgccctctggctgctttcatgggctggtgttgagtacctgtggtttttccaggtgcacagtgcaagctgtcagtggatctaccattctggggtctggaggacggtggccctcttctcacagctccagtaggcagtgccccagcaggaactctgtgtgggggctccagccccacatttcccttatccactgtcctagcagaggttctccatgagggccccacccccacagcaaacttctgcctgggcatccaggagtttccatacatcttctgaaatctaggcggaggttcccaaaactcaattcctgacttctctgcaccctcaggctcaacaccaggtggaagctgccaagtcttggggctttcaccctctgaagccacagtctaagctgtatgttggcccctttcagccacggctggatcggctgggacacagggcaccaagtccctaggctgcacacagtatggggaacttgggcctggcccatgaaaccactttttcctcctgggcctccaggcctgtaatgggaggtgctgccatgaaggtctctgacttggcctggagacattttccccatggtcttggggattaacactaggctccttgttacttatgcagatttctggaactggcttgaatttctgcccagaaaatgggttttacttttctatcatatagtcaggcttcaaattttccaaacttttatactctacttcccttctaaaactgaatgcctttaacagcacccaagtcacctcttgaatgttttgctgcttagaaatttcatccaccagatatcctaaattatttctctcaagttcaaagtcctacaaatctccagggcaggggcaaaatgatgccagtctctttgctaaaacatagcaagagtcgcctttcctccagttcccaacaagctcttcatctccatctgagaccacctcagcctagagtttattgtccatatcactatcagcattttgggcaaagccattcaacatgtctctaggaagctccaaactttcccacgttttcctgtcttcttctgagccctccaacctgttgcaacctttgtctactacccaattccaaagttgttttcacattttcaggtatcttttcagcagtgccccactctactggtaccaatttagtgtattagttcgttttcacactgctgataaacacatacttgagactggggaaaaaaaagacatttaattggacttacagttccacatggctggggaggcctcagaatcatggcaggaagtgaaaggcacttcttacatggtggcagcaagagaaaatgaggaagaagcaaaagtggaaacccctgagaaacccatcagatcttgagacatattcaccctcatgagaatagcatgggaaagacccacccccatgattcaattatctccccctgggtccctcctatgacacgtggggattctgggggataccattcaagttgagatttgagtgggcacacagccaaaccatatcatcttctatgccacaggtactggaatataacttgaagagatcctggatcccaactcacattattttggggaagagaaacaagtagttgaataaacaaaataaaatccagtttatgaaaagtgctataaagaacacaaatggggatgctgggtctttatgtaataacaatggggcctttaaaatagagtatggaagaagctactttagatggctgcaagtgggaagccctccacggaggttcaagctgagatataaaggatgagaaaagtccagtcacatgaaagcacaggaaaagagaaaccttggaggcccagcaatgggggagattggagtgtgactgctgcagtgagccagtggctggggaaatgcgtgattggaaaggagaacaaaagccaggccatgcaaaggctcgatgtgtcatggaaacctgtggaaagatgttaggttgggacatgttttgttcctgggatatgaattacatttttaaaagtttatttttgtcacttaagagaatagattgaaaagggtaaaattaaacactaggagatcagttagtgaatgatctgggcaagagaaatctggcttgaatcatggtggtgagggtgcaggtagaaagaggtgagtctgagatctatctgggagtgtcacagagagcctgatgagaggaggtgagggatgggagaagggaggagtggaagtaggtgacttttaggttgttgcctggtaaccaagtggataatggtgctatttactgaaatgtaaagatgactctgctgggcgagggcaggagggaagtcatagaatgtacttgggatatgttgggatatctaaggctacttgaaatgcctatgagacattcaacataaatttcaaataaatagttggatataagcctagatctagggggaaagttggagctaaagacataattagcatttatcagattatagatggtagatagatctacattcatgggagtgtgtgagatcaactgcgaaaaagtacatatgtgtaagaaaagagtgcttaaaacctactcgtgagaaaattcaatatttaaagataagtaaaggaggaggctcatgtgtagagtctatatacaaattggaagtggtggtgactgaaaaaaatgcattaaaattaaccaaattttctcttttctaggcactgtcctaattgtagatgcttgagaaaatagagatgtaatcatggatacccaccaggtatttgagtcaggttcttcaatgcaaaagtcacatagaagctgctgctttaatgtttgtaacagacttccaaactaatgtctcttataatgtccctgtgtattaagatttccataaaaccattacaatttctatttattttgtctagatgtaaagcagacggcatatcatattacatatattgctaaaattcttgcagcctaatgtatacagatttgtgaattttgagtgatctgaagttcatgaatattttgaggttggtttgttttgtcttgttcaaagcctagatatcatgttttttcagtttaacatatttcttgagggaaaagaaatgtttagatttccagctagttataaaattgtcagaaagaatagaagttaaacatacagagaaacaaaggttacacatctgggaaaatagtagaaaagcctttatatagtcttggcaaatgaattcagaggttttatttttaatcacaactgtgaagaaagaaagattaccttttggggaaattaatgaatattgtgggcttagacataaaataattgttaattgctccatttattagaaatcatatgtcaaaagtgttttatcatcagtaatacaatagcaatagagataaaaatatatacggatatttgattttgatgattttaatctcctatgccatttccataacaacatgattattcacacctgtcaaactgatgggtgagaatgtcaacttgcccttgaatgccaaagactattttcagacccttgagttttctcaccaattcaatccattttgcatgcttctgacatgccttttagaagaccaatttgcttatatctctttacctatttactgaaaccctcatttattagcttggcattcaaagtcttctacagtcttgccatatctcactttaaatctgtttctccccctactcaccttctccaatgcaatccctatgttgtaatatggctaatctacttgtttttttaatgtatttcatgttactactatcttgaagtgttttctatgtatttctgtctctacactgtgatcctgcattgtgccatctacttagtgacatgcattcccttctttgacacatgtgtcttacgtgcctttgtcccccacatattacctagactggtgccatatcatagacagtaggttatcaataaatgcttcttggttagttagatgattagtatacagtatgcttttgatgagaagggtaaagaaaatcatcagagaagttaatggaattagactccaccctgggtgtctctgccttcaaaactcatgtctttcacattattccacgccaactcccacagaatagtatttgtcttagtccatttctgatgtcataacagaaaaccggagatcaggtaattaattatatgattagttagaaaaagattcataactagaacctagtgctccccatttccctcatgcttgataggtttttaaaaatttattgaaatagttgcaattttgtcaaattatttttgactcataattcataccttctgatatttcttactttgtaaaaatgattttcttctttccattttgtatctacaattcagcttcggtttctttcttttcatttctacttttcccttttgtttaaaatataacccattacaataaacttaggaaagactgtactgaatattgtctctataaagggcatgaaagtctccttaatgtgaagttgaggtagcgttaaatatacacttaattcagcaaactgacatctcaccaagcaatctttttgctatgtggacacatttgtgtgtttgtgtgcgtgtgtgtgcgtgtttgtgtgtgcgtgtgtgtatgtatgtattgcgcatgtgtgtctgcacattgtagagaatggcattttcacattaccacaaaaacactttatataagaaaataattctaaattggtccataggagagggagccataggatgggttagaactgacttctgtctctgacttctccatccccattattttgttttgtgtttctgaagccagttttacatcttagtagagccataaataatgacaataagctggaaaggctggcatctacgagggtggagagaagaggtcaataacatacatatatagtcttgggggtgctaaatgttgagtaaagctaactccaagcagagcacaatgagtggctggagaaaaatacctgtcagtctccacactttcaattccagggtgaggaagggtccttaccagacttgagggagcttttgaggtgttctagccaagctcttcaatgaattgtcattcaggctacctgcctactccttcggctactctacccaaagttcctgccccatgggtggggccactgcatcaaacaactctccagggagaaccattcacatcatcacctatgcctatctgaatggcacctatgcctatctgaatggagcctattcaaccacagtccatacggctttacctgcagccttgcataaaaccttgtagaaatatttcttcaaattcctttctattttctgattatcttttcttttcttttttttttttttttgcttatttttagggcgcaaatatttaaattttagattttctttacattaacaatgcaaaatacacacaattcattcacaagttagcaactcagctaatgtagacacttctgggcaatggctggtgttttgttttcagatatggttaagaaaatagccatacaatggctcctgtttgggctctgaagccaacagactccttcctctgtccccaaataggataacaaaagatttagggaatattcaatacttttctcaaagaagtaagtgatttgagtgtaagttgctacttccctgtaagaaataacagcaagcatagatacgcctaagggaaggcaggacgaagccgccactttccttggagtctaaaactctgacctgaaaagtgttcgcaagggattggaaccaaagccaggattgatttgctgagatttgcactctcacctaatggcctgaggaagcagtgctgctgtcttggtttgttctggcagctataacgaaataccatagactgggtggcttataaacaacggaaatttatttctcaccgttctggaagcgggaagtccgaaatcaaggcctgacagtttccgtgtctgtgggagggccgatttccttgttcacagagagcaccatcttgctgcatcctcacacggcgtgcggggcgaggcggttctctgggccctctttcatcagggcaccgatccccttactgatgggggctccgcccttacgatctaatcacctcccaacagccccccttcccaacactctcacactggtgactagatttcagcatgaattctaggggagccacaaacactcagaccacagcagtgaccaacgtagcattagtcaagaaagcccaagacactcagtctctgctagggaggaagatcttatcggtaaatgtgaacatgtatttcaggattcaagaggtgattagaagtgaacagttttaaagattacagaaagcacagtggcaatgctttaaaagaaagactgctttcctgtttgagtaagagcaagaatattaaatcaggagcattcgccaattgacattcctgtgctggtgtgaggagagggcagacgttcaagtcagagctcagctatccagctcatcttcactccactggactctgaggccagataattagattccttcttttctcccaaatttatatttcatcacaaagctgaatgacctttcctgtcagtgcaaccaacaaagatggctgggcaggaagtaaccagacgttgcaggccctcccacaccaaggaagttgtatattgcaaccacacagactgatttttgttttaatgccaagctatgcagctcggctgtcagagcaatgaagtgaaaataaaattaggggccaaatgtctaaaccctcaagaaatgtcatggataagaagaataaaacaagtaaaaggttttcctttttttgttttaatgtttaaatatatatgaattttgttatcagtgcactgaaaatggaatcagtgacccgttggaccaaatgcttatgttcaagaaatgccttgaactttaaataaactccatgttattttgctttggattaatttacttgcagatgtgtgacattgcttgggaatataggtccagctggaaaatacagacagaggcagggcagaacctaattttcttacgattcagactttgctgaacagacaacatagctttcaaaagaaacatgaacttctctttcttattcacttcagggacagagagattgaattgaaggcagaattcggagtttcctccaatgaccacaaaatagcattttaaaatcttgtcgtgtttgttttttgcggctgttttgatttttttttcttttcctcagcaggcttgtgaatttccaagtagccccatcctgctgcttcttcccttattcctgtatttattagcagagaggatgcagtcagcagctctgcagccatagggaattcacatcacctctctgagccttagctttctctctgtaaactgagagcattgggctaaataatttcttcctccagtggttggtctatttcctaggtctgtgtggagttactacttggatgtccctgagggggaggtagaatctcttcactatagcccccaatactagaggatcagttagtcagtcagccaaagagatcattcacgtcaatttgtgaaggaggccggggtggtggcctacctacgctccaagaacctagtacctcctttcccctctcctatcagatgacttttttttttctgttttcagtttgctcttctatagaattatactacacttttactggtatatatagaaaagcaattttcattaccataaaggattagaaagcaaaactttaaaaactaagctcatgcaagtatcttcacatcttagaatattaggggagatattcatatgggatgctgactgatgtcaaaaggccaaacatacaattatgggggttaccatcccatttgtatattacctccttgttagaaatcaatagtttattgattatttttcacattatttttaagaatatttttaattgtcagacagtaacagtaagacatttttaaattgttagtaaaataacttctatgtataaataacctctgtcttagtgaagtaacttttatttattagcaaaactaaatcttattcatgctcgtttaagcaaaatgaattacaggactatggggtctattaatttgctaggtctgctgcaagaaattaccataaaccaggtggcttaaaacaacaggagcttattctgacagtctgcaggccagaagtctgacacccaggtgtcagcaggccgcgctctctcggaaggctcagcggggggtccttgcttggctctctcccagcttctggtggctgcctggcagcccttggcggacctcggcccagcctgtctcagcatcactccaatctctgcctccgcctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgcctctgcctccgtctcctcctctgggtggccctgcctctgcctccgtctcctcctctgggtggccctgcctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtctctgcctccgtctcctcctctgggtggccctgtcttcccctttcagaccctgagaagcacacctgccagtggacctagggcctaccctaatccaggagggtctcatctccaaatctttaccttactgacatctacaaagactattccaaataagatcttattctgaggttccaggtggacatatcttttggaggtcaccgttcaacccaccacacagggagggtcatggagctcaagtgaagaaacagcacctgggctcagcagccaccgaaaatagcaattgcggaacccgttggaaaccaagctcattttcttggccctcctctcgccttccaggctgcatggctccttcatctgcttctctctgactggcagcatcaaccacttttctctgcagcctgtgtcagcttaggacagaagagaacccttacacttacatgcgtttagctccagagcacacggacagtggctaacctctgcctcatttctacattcctgagaaaaacaatctcatgggctagttttggttaagcttctgtcatggatcccatcagctgtagttgagacaatggtcaggtaagtaggtgctggaagggaaagacattctcagtttaacaaagtattttaaatgaagtcacaatagtgtaaaagttaataataatgaggtttctaaatactctttccaatgtttttcactaaagttcattaagtactattcaaatagtacttacgtttttaaaactatcccccaaatacttcagagccatctaaaatggttgctgggtttagacttccctgacacctatgatgagtcataatttagttatcaattttagtggtctactcttatcataagggcctgtgaggaaggtcaaggtagtttgcagtggcttttctagaaaatctttcagaaggctccaagctgtattgcctgcaattaggataataggcttggcttctgtcagaaggctcctttcagttctgtaaaagttcctgttggtgagtggtttattgggcctatgagatgtgatctctttcttctggaaagaggtccctatatggcagtaatggaggaatacgtcctggaaatgagagagcatatgtgcttggaagcgaggtggtggtggtggggggtgttaattagcatgacaggaagagaagacctattcagaaaacataatggtgagagagggaaatcagaagcgatatactggttggaaaccaaaaagcctcagggagacagagtcaaatatgatggccataattaaatcaaataatgtactccttttccttgacaaatcagtgagccttcagaagtgtgtgaagcttgagattcagacatgaaatgcgaacatgtgaggatatgagacagcccctgtggcccatcttccaaatctcagaagtgtgtgaagcttgagattcagacatgaaatgtgaacatgtgaggatatgagacagcccctgtggcccgtcttccagatctcagaaggacagaatgaacaacttcagaatcttagtgtcaaatgtaggcatggtgcttgatagcaaaagtgcatcaggttcaaatcttagaaaatagaattggcatggatagggtaaaaaattggtcgctatgagaaaagcagcattgttgatttcatttactaactgttgtaataatgctgtgtgtgtgttaactgaaccaactaggaggaaaatgtaaggaagagtgctcccttgttattgaaatgggcttggaagtcaaagagggaatgtctggtaaaggctatagcataagtaggatgacccaacaatagatttaacagattatatcaattatctggataaacttacataagagtggtactgatatggctattacatgcgagggactaaattgtgtccctacaaaattcatgtggaagccttaacccccagtgtgactgtatttggataccagaattttaggaggtaattaaagttaagtgaggtgataatggtggggtcctaacctgacgggtttggtggccttacgaggaaatgaagagagagagctctcagtctctcacataatttggaggcagaagatccagtctgagggctggtcacgtaggcattcttgggagagggcagtacaggcatgcctcagaaatattgtgagctcagtttcagatcactgcaataaagagaacatttcaataaagtgagtcacaagaagaatttgatttaccagtgcatataaaagctacgtttatactatactgtagtctactaagtgtgcaagacaccacatgtacttttctaatgttctctctctccatgcagatgcacacaggaaaggccatgtgaggacacagcaagaaggctgcctctacaagccaagaaaagagccctcatcaggaactggtctgctggagcttgatctgggaccttcagcctctagaattgtaagaaaataaacttctgttgttttgaccaccagacttacagtattttgttatggaagcctgagaagactagtacatatgaccatagccattttcacaatgtttagcatatgtttacatctcttttatttatgctatgaaattaccctgacataatgctcatatttaaagatattacctactatatttttctttttggatgggtgtagcattttgtgggtagctggattttttgatcagacaaagttcagaatcaaactgccaatataatagttctgtacgagaaaaaaaaaggtaaggaatggaagatagggatactataaagtaggagatatacgacaggaaatccatgccaataactctacatttacctcctaaatgaagatgtagccttgttgatcattggtttcaacaaagtatcaagagaggcactgatgtctgcccataagtgtgcaaacttttaggatgttcttcctgaatgggtataaaaaggctgaggaatagtaggaaactgagatactctgatcaagcaataccccttctgatgtgaaccacgtctgcctatatatttggctaaataaattgggaacttaatctaattttgtcttggttgtctttgtgtagtagttttttcctgctgaattctaagtccaccttaagtaataaactttaaaaatcatttgtcctttctgggttctatgctggggtcgagaaggtgtcattttagtatagataatgtaggcattttttttccaaggagtgaaatatttattgtgaataaaattgaagatattaatttccaaattccccttgttggtaaagacataggaagaaaacagaaatgcccttggcagatgaaagaaggattgctaggcactgcagactcagtacatggggaagtttaaaattaagagacaaaagaacaagtttgtaaagccagctttagaggtttcacaatgaaggagcttaaaagtgaaggctttggacattcagatgctggagcctcggtagaggcaacatgctgggtagtgctgagtacatttatttagaagtcattgaattgtcttttctatttatgatctgtgtattgaagctattcaccagattcttatttgtgcttttcttcatagcatgcattttacttgccattaattgattcaaaattatttttctagcaattattcatgctgatgtgctcaagctttattgttagatctagaaacagtgataggtaagatgtcctgagtacttgcccagggatattcactaaatcttcacagcaattctaggacagagtcaacattaccctgtcacagctggggatgctaggccttagagaagtttaggaacttgtccaaggtcacacacaattagtaaaaatagtagaattggaatttgaacctgggtagttgggctccaggcctcctcctcttatccattttatcaaaccaagtaacactgtacattgtttacgttgttttattggaattatacatagcattctggagtgcaacttagattcaagataccacatgtactttttatgttctgaagttttacatctaatctattcctacaaattaatgtattttaatcataatgtcagtgtagcatctagacataaaaaaatgggtatattaccttgaaccacccaaatttgaccagtaggttgaaaagaagtatggctgcattctgcgcttcctctctgacactctagcacagggcattgaggtataagagaatatcaatattggcacatatccaactcacagatgtttgtcttttcttgatgctccctggtgccttagctttggccacagtgcacataagcaaagtgacagggcaagagagccacaaggagaagaggctggaagtgcaagaaggctgaatgtacgtgagatgtagaccaagggccaggggcccagattcacaatagacatctgcagtgggaggttgctgcagctactagagattgcaagaaggcaactattagaatcgaagtctgtcatgcctgctacatgaactgcaaacataatttggaggcagaagatccagtctgagggctggtcacgtaggcattcttgggagagggcagtacaggcatgcctcagaaatattgtgagttcaatttcagaccactgcaataaagagaacatttcaataaagtgagtcacacgaagactttggtttcccagtgcatataaatctatgtttacactgtactgtagtctattaagtatgcagtagcattattaaaaaatactctacataccttaattaaaaatacttcattgctaaaaatgcaaccaacaatcagagcctccagcaaagtcataatctttttctggtgggaatcttgcctctatgttgatggcttctgacggatcaaggtgttgaatgctgaaggttaaggttgctgtggcaatttcttaacataagacaacagtgaagtttgctgcatcaattgacttttcctttcagacaatatttctttgttgcatatgatgctgcttgatagcatttttgtcatattagaacttctttcaaaattggagttaattctctcaagccctgccactgcttgatcaactaaatttatgtaatactttaaatcttttgttgtcatttcaacaatgtcacagcatcttcaccaggagaagattctgtcccaagaagccactttcttagctgatccataagttgcgattcctcatctgttatagtttgatcatgagattccagcaactcagtcacatcctcatgctccacttctaatttcagttctcttgctagttctacaacatctgcagttactttctccactgaagtcttcaatccctcaatattatctgtgacagttggaaccaacttcttccgaactcctgtgaatgttgacattttgacctcctcccatgaatttcgaatgtcctgaatagcatcccaaatgttaaattctttccagaaggtttccaacttacttttcccagatgcgtcagagcaatcactgtctatggcagctgtggctttatgaaatatatttcacaaataataagacttgaaagttgaaatgactccttgatccatgggctgcagaatagatgttgtgctagcagacatgaaaacaacattaatatctttgtacatctccatcacagctcttaagacaggtacattgtcaaagagcagtaatgttttgaaaagaatcctttttgtttttctgaaaagtagttctcaacagtgggcttaaaatattgagtataccatgctgttaaaagatgtgctgacatcctagcttccctgttccctttacatagcacaagaagagcagatttagcataattcttaagggtcctaggatttttagaatggtaaatgagcattggcttcaacttaaaaagtaacgagctaggttgggtgttgtggctcatgcctgtaatcccagcactttggaatgctgaggtgggaggattgcttgagcccaggagtttgagaccagcctgggcaacatagtgagaccttgtctctagtaaaaatgaaataaaatatttttgaaatttgaaaaaaaaatacagcagttacattagcccttcacaagaaagtcagcctgtcctttgaagctttgaagccatgcattgacttctttccagttatgaaagccttcttaaataggagatgccatttgcctctgatggctcttctttcagtaggagggtgttttgtatagattaaaaatcagttgtttagtgtagctacgttcatcaatgatcttaggtagatcctctggataacttactgcagcttctacgctagtatttgctgcatcacctagcactgttatgttatggagatggcttcttttcttaaacctcatgatccagcctttgctagcttgaaacttttcttctgccaattcctcacctctctcaggcttcatagaattgaatagagttagggccctgtgctggattaagcttcggcttaagaaaatattgtagctggtttgattttctgtgcagaccactcaaactttctttaaatcggcagttaggttgttttgctttcttaccatttgtgtgttcactggagtagcagttttaatatcattcaggaacttttcctttggattcacaacgtgggtaactgcttggtgcaagaggcccagcttttaacctgttttggctttggacattctatccccactaagctgaatcatttctagcttttgatttagggtaagagatgtgtgactcttcctctcacttgaaaacctagaggctactgtggggttattaattggcctaattcccgtcgttgtgtcttaggcctgaggagcgggagagagattggaaaatggctggtcagtggagcagtcggtgctcatgcaacatttctggattaaattctttgtcttacatgggtgcagttcatggtgcctcaagacaattacaatagtaatatcaaaggtcactgatcacagatcatcataagaaacacaataataacgacaatttgaaatcacaagaattaccaaaatgtgacatggtgatatgaagcgggacatgctgggaaaatggcactaatagacttgcttgaggccaggttgccacaaaccttcaatctgtaagaaatgtaatatctgcaaagcacaatagactgacatacaataatatgagctaggcctgtgttatcaaaccagagtttgctttagcaacagggacaccatcttggttagtccaattctcatcttcggagatctggagtgcatctctctgagagtctgtacaatccttgttagaaccctgagttcagagtaataaaaagggatgaaatgattaagggactggacttttgctagacagtagactcctctgtgtgccctaggttgttcttctcctctaacacatcagagtagattgtatcttaaaaaggagtatttgtgttcagagcaactgctgttgtgcctgctcttcaggtgacagatggtaggcttctctctgaaccaaaagcaatgtttgccatcctaaaaatgtggacataatatgttatatgaaagtttttatttgaggccacgtaatatggctttatagttttgtttcctggttattagtcttatcaaagttactgctggaatgcctgtgcagggaacaaaaagaggatgtcaaggaagcagtgaccagcaaatcctgatagaagtttaaattccctgacaatccaataggaataaagacataatcagctgcatattggagcacattattaaaacagccactcaggttttgaaatatccatttaaaatagttcaattaaaacccaattacagaaacgttccacacgaacactgaaacatctattttattatgattctgcatatcagtagcctttaaatcttaaagatgaaccaaaatgtcttttaaaatgagcactaaaaggggagacccacaacatagtctctgctgcttcaaaggggtttctgccttgatttaagaacatgagttccagttgtcccaattaccgtttacagtaaccgaaagaataataaatagaggatgcctgtgagtatctgttgtgatgcaagaaatattcatcttaggcacactaagcaactaaaccacaaaattggactttttgcaactgttcgaaaagttaactaaagatgaatatgcattttatgcatatcagtgcttttatcatatgccatttaattataggttattttaaactattcattcataaaaaattaatttatttagcactttagaatacctaagacatatagtaatataaatgtatgcaagattttcagaaagtcacttcttattttgcatttttggctagagttctctttcggcaaatataggtgtgagccagacctcacaatgtagcaattatgctttttttttttttttttgagacagaatctcactctgtcacccccagggtggagtgcagtggcatgatgtcggctcactgcaacctctgccctctgggttcaagcgatcctcctgcctcagcctccccagtagctgggattacaggtgcatgccaccaagctcagctaatttttgtatttttagtagagacggggtttcaccatcttggtcaggctggtattgaactcctgacctcatgatccacccgcctcggcctcccaaagtgctgggattacaggcgtgagccaccgcgcccatccacaattatgcctttttcccggctcactaaggatttagagattcatattcctcttcttgtcacagccatgaattcctttcagcatccacctgcatgctttgcctggcattgtctgcttgggaaccagagccctgttactgtcttacttgaaaggcaagttttcctaagctatctaccagattactttagatcatagccttctttagatttctctaaattatatgtctttggacctcagatatacatggtcttcttttgagaaatgtctattcaaattttttgctcatttttaaattggattgtttggtttcttcctattgagttgtttcttgtatatttcagatgttaatcccttattaaatgtagggtttgcaaatattttcttctattccacaggttctctcttcacttggatgattgtttcctcagatgtgcagaagcatttaaagttgatataatctcatttgtctatttttttttattttcttgcttgtgcttttgggttcatgtaaaagaaattattgctcagaccaaagttatagagcttttcccccatattttgcttcagcaggtttatagtttcaggccttacatttaggtctttaatctgctttgagtttacttctgtatgtggtgtgagatagcataagacatacaaaaggccagcaagtatacggaaaaagaagacttgcaaataaccaacaggcatatgaagagatgctcagcatcactaatcagcagagaaatgcaaatgaaagccacaacaaaatagcagctcacacctgttagaatggcttttatcaaagagatgaaagttaaatgttggcaaggatgtagaaaagacgaaggccttgcatactgctggtgggaatgtaaattagtacagacgtcatggaaaactgtacagagcttcctcaaaaagtaaaaatagacctaccatatgatccagcaatcccactagtgggtatatatccaaaggaaagtcaatagctctgtatgacaggtatttgcattctcatgtccattgcagcattattcccaatagccaagatatggagtcaaactaagtgtccattaatggttgaatcaataaagaaatgtagtatatatacacaatacaatgctatccaacctttaaaaagaaggatatctggtcatttgtgacaacatggataaacctggaggacattatgttatttgaagtaagccaggcacagaaagaaaaatattgcatgatcttacttacataattgcatattaaattgagagaagctgaactcatagaagtagagagaatggtggctaccagaggtttgggagatgttggacaaaacaaacaaacaagaaaagtaaggatgtaacttcaaaccaaaaataaaggagtaccaacggctttttgactgaatgcccacaaatacggcagctgtcactttgtttacctttgtcatactgattttgtagttggacctgtcatggccattgctggaattaacaaatgagtggaatgattacaaagaaaaattgaagaatctattttgttaatttttatggtaatgtatattgagagattatgggtttctcaagaatgccagtaacggccagatgcagtggctcatgcctgtaatcccagcactttgggaggctgaggcaggcggatcacctgaggtcagaagttcgagaccagcctgaccaacatggagaaaccccctctctactaaaaatacaaaattagccaggcgtggtgatgcatgcctgtaatcccagctactcaggaggctgaggcaggagaatcgcttaaacccgggaggcggaggttgcggtgagcccagattgcgccactgcactccagcctgggcaactagagtgaaactccattaaaaagagagagaggagagagagagagagaaagagaaggaaggaaggagaaaggaaaaaaataataccaataacatacttgtgcatggctcaacaaataatatttttattcaagatatatttacaatataagaatgcacaaacacttcagtgtgtttatacattggcatatcggggttttattattaatgttggcgtatagcttttcatcaggcctcttccttactcaaaaatatgtgaatttccccaattttctgctttatcaatccccagactcctctgtctggttgtcaattctctctccagttccgctccaccgtatgcattcaacaatatattttttgactccccaaggtgcacactctacttaaacttgccccctcttcacctgtgttaactccacccaaacttcaggcaactgtatcacatcagcaacggagcgttctctcaaatacctcagcccttacacactcagctccccaactgagcacttacttgaggacttaggtgtacatttatatcaatttgtggtatgacacccttttatcattttctacttgtcactctatctccctgcaactgctctgtaagcacaagcatctacatagtgaatagccaacaatgaagttcagactagcaaagtattgacaatgccattttctaggtcagtttctgagtgggctgagatgactgaaagtagaagtcaactccagaagcagctgatttccagcaaaaagagcgatgattactcctctgcttaccagcagttacacctattgatactggagcctccccctaccacgaggtagcttctgctgctattatcttgctgctctgggtgagtccctgagaattcggggttagggaagtaaagaggggagcaacagtctgtaatcaacttaggacatttcattgctataatctcattactcaagagtttttttttaaatatcatagaatataattaagtctggtcccaatttttgcccagatgggaagaaaaggaaaaattcatgaaatataagtctaaggtgactttttaaaaattgtattttctttttggaaataacaaagtctataataaaatgtttatgtaattttaattataagattgtaaataaaatgcatgcatatgaaatgcatttattacaacttttatacaattttgtgaagctaatcatatatatgtgtgtatatatatatatgtgtgtgtgtgtgtgtgtatatatatatatatatacacctctgtctttatatagatttctttgcatggatctatccagacagataccactctttaaagttttatatattttaatctccagtgagaaataccaaagtgaactaggtcatctctttccatggtggagctgatggctgactccaactgtgaccaaatgatctctccttgaggccagataagaaagatgaacatgggattatttttccttatgtgtattttcaagagctcattaataatttcagtttcatgttgatgagagttagctttcagaaacatttattttatacaaaaaaaaaagactaagagctcgttatctcttcatgatgatataacttttctgcagaatttctaaaaatcttaaaggacaattgtgtgtgtttgaggagaaatacagggcctgactcagaatcttccagttacattctctcttgttacgtttataaattctataccctgaaaacaggaaatatgttccaactgttggaaactttcagttacaactgatttgtgtttttctgctatgttcattatttcagtttgttattaccaacgatctctcttttcttaatagaccaaaacataaacaactcaggcttccttaagaaatcttggctcgctgcaacctctgcctccagggttcaagtgattttcctgcctccacctcccgagtagctgggattacaggtttccaccaccacacctggctaatttttgtatttttagtagagatggggtttcaccatgttgtccaagctggtctcgaactcctgacctcaggagatccacccgcctcggcctcccatagtgctgggattacaggtgtgagccactgcaccaggcccataatttctaataattatttatacctactctatgttctgcactgtgccaaattctttgtatggatcatctcatttaatcttcaaagaaactcagtgaggtcaatataattattatcactgttttctgagaagaggactgaagcttaaattgcctaatgatccatgaaaatgcactcatggacatcgacaccccccaccccaccccaacaccattgctgctgccactggtgcaaacacgcatgcagatgctcatggccaagcccccgccaatgaaccacccctgccgctgccagtgcatgcacatgcgggaagaccacagccctgttactgctggtaccccccagaagctaacacgtgtgcacctccccacaacacagctgctggcacacatgagcaagcatggatctcaaagccccaacaaagtgccttggtgggtaccacccaacaaagtgttgtggccagcagactgggaacatctctgcccctccagcacagcagcttccttacctggaacagacagagaacaaagcaggggcctggtaccagctcccagagttagagtacacaccctgggagtgctgagctgagctttggccccctaaaatcttccagaaatgaagccatttgattgaacccaccttataccacaagcaaaaccccaaggtcatcaaaagagataaaagcaaaaaatctccatccaaaagacagcaacttcaaaaactgaagaaacatcaactcacacacatgagaaagaaccagtacaagaactctggcaactcaaaaagtcagtgtcctcttacctccagacaatggcactagtttcccctcaatggttcttaacgtggctgaaatgacagaaatagaatccagactatggatatgaatgatgatcatcgagattcaggacaactttgaaactcaatccaaggaatctaaggaatacaataaaattttccaggagctgaaggatgaaatggccattttaagaaagaatcaaactgatctgatagagctgaaaaactcacttcgagatttcataatatgatggcaaggattaacagcagaattgaccaagctgcagaaataatcttagaactcaaaaaatatatgatttaaaataatcagacaaaaatttaaaaaaagaatcaagaagagtgaacaaaaccttcaagaaatatgggattatgtagatacaccaaatctatgactcattgacatcactgaaagagaggcggagaaagcaaacaatttggaaaacattttggtgatattgtccatgaaaaatttgccaacctcactattgaggccaacattcaagttcaggaaatgcagagaatccttgcaagatactatacaagcttaccatcatcaatacaatagtcattagagtccccaaggtcaaaatgaaagaaaaaatgttaaaggcagccagagagaaggagcagatcacctgcaaaaggaaccccattaggctaacagtggacctttaagcagaaccctacaaaccagaagagattgggagcctatatttagcatcttaaagaaaagaaattctaaccaagatttttatagatagccaaattaagcatcataagcaaaagataaataagattctttccagagaagcaaatactaagggaactcattaccaccagatctgccttataggaggcccttaaggaagtacttaatatggaaaaattactggccaccacaaaagcacacttaagtacatagaccatcaacactgcaaagcaactgcacaatcaagtctgcataataactagctaacaacatgacagaatcagatctgcacatatcaatattaactttgtaattgggtgaaatgccccaattaaaaggcagagagtggcaagttggataaagaagcaagacccaaaggtatgctattttcaagagacccatttcacatgcactgacacctataggctcgaagtaaaagggtggagaaaaatctaccaagcaaatggaaaacagaaaaaagcaggggttgctattctaatttcagtcaaaacagactttaaaccaacaatgatcaaaaatacaaataagagcattacataaggataaagcgttcaattcaacaagaagacctaactatcctaaatacatatgcagccaacacaggaatacccacattcacaaagcaggttcttagagacctacaaagagacctagataaccacacaataatagtgcaagacatcaaaacaccactgacagtattagacagatcattgagacagaaaattaacaaagatattcagtacctgaacttgacacttgaacaaataaaggaagtaatggacatctacagaactttccactcaaaaccaacagaatatacattcttctcatttgtacatggcacataccatatatcagccacacaatgggccatcacataattttcagaaaattaaaaaaaataattgaaatcataccaaccacactcaagaacacagcacaatataaacaaaaatcaacactaacgaaatcactcaaaaccatacaattacatggaaattaaacaacctgctcctgaatgactttggggtaaacaacaatattagggcagaaatcaagaaattctttgaaactaatgagaacaaagatataacatatgataatctctaggacacagctaaagcagtgttgagaggaaggtttatagcactaaatgcccacattcaaaagttaaaaagatcaaagtaatgacctaacattacacctgggagaactagaaaaacaagagtaagccaacctcaaagctatcagaagacaagaaataaccaaaatcaagagcggaactgaaagagattgagacagaaaaaacatatcaaaggtcaacaaatcaagaagttggtaatttcaaagaacaaaaaagattgatagaccactagataggctaatagagaaaaaaggagaagatctaaataaacacagtcagaaatgacaaaggggacagtatcaccaaacttacagaaatacaaaaaactctcagactactactacaaatacctctatgcacagaagctagaaaacctagatgaaatggataaatttctggaaacatacggcctcccaagattgaaccagagggaaattaagtccctgaacagaccaatgattggttctaaaatagaatctgtaataaaaagcttactaacaagaaaaagcccgggaccagacagattcacagctgaattttaccagatgtataaagaagagctggtaccatttacactaaaactattcctaaaaatggagaagagacttctccttaactcattctatgaggccagcatcatcctgatatcaaaacctggcagaaacacaacaaaagaaaacataaagccaataactttgatgaatatcagtgcaaaaatcctcaataaaatactagcaaactgaatccagcagcacatcaaaaagctaatctaccatgatcaagtaggttttattccagggttgcaaggttggttcaacatatgcaaatcagtaaatatgactcatcatataaacagtaataaaaacaaaaaccactcgatcatctcaatagatgcagaaaagacttttgataaaattcagcatcccttcatgttaaaaattctcaacaaattaggcactgaaggaacttacctcaaaataataagagccatctatgacaaacccacagccaacatcatacggaatgggcaaaagctggaagcatttcccttgaaaatcacaacaagacaaggacaccctctctcaccactcctattcaacacagtactagaaagtcctagccggagcaatcaggcaagagaaagaaataaaaggcatccaaataggaagagaggaaatcaaactatctctgttttcagatgatataattctatacctagaaaaccccatagtctctgcccaaaagcccctagatctgataaacaacttcagcaaagtttcaggatataaaatcaatgtacaaaaatccataacatttctctacaccaacagcttccacacttagagccaaatcaagaacacaaccccattcacaatagccacaaaaagaataacatacctaggaatacaactaaccagggtggtgaaagatctctacaatgagaattacaaaccactgctcaaagaaatcagagatgacacaaacaaatggaaaatcattcatgagtggataaaacatactccccgtctttaccttggctttccttcttcatgattctattttgaaactatgtgagctgtggttaggctccttattttgagaaactgctcaagataagacaagttattaaaataaaatattattggcaaaaggatgaaaagctagaaaacagagcaagatagataatgcaacggatagctgagggctttgaaaacatatattatataaagttctgttttcttgttcttaaggaaaagttttttaaccaaaaaacacaagctactactcctagagtggataaaattctcaaatgcattttcagaaccttacaatgtggcttcaaaatgggcattatcaataattactcaaaggcctgatgctatttaatagcagacagaggaaggtcactgtcttttcctgatccagaaagtttttcctattttgactccatttttttcagatgtagtttgactccagtgatcaatacaaattcaaattgaataccgtgcagcaacaaatatgccatagtgccttttcctttctttttggcctttttttgaacaacattaatcgacagaagaaagtcaaatggttatagctaagagaaaaaaataaataaaaaggcttctgagccataaaagtacaaataaaaatgtgaaaataatttttggaaggcttgatgaattttatcttttagatttagtgcattagtttacattatgttgggactttggtttatgtaaaaactggatagtcaaaattattaataataaaataatgtgttctcaagagtaaatctcatgtctttaaatcatatgaatcattcatcatcataggaagccatgaatttccattacatagctgaacagttggagcatcccacaacaatggaaatgtataagtggggatgataatcggagggttcatgtggtagagtacagtctaaccagctggaggttcagtgaggcatgtgtctttccccctgtggtcacacaatgaccatgcagttggcatgacaactcttttttcctaccctacgaacttcaggcactgctactatttgtcagatatctttaaactaagtcaacaagatctatacttaggaatatttaattaattagatgtccttactaaagttaattaatttatgagatatgaaggatactttgtaataagaatagttttttaaaaatatgaaacaatttccaatccagatatggacaataaaattaaactgaatgtgaactgtttggtaaaagacacagtgagatttggatgatatgaaactttttcttggaaaaaagtcttttttgatatgtatgtgaatgaccctatataaatggtaattacatgtactaacacttgaaatgataagtgagcaaaaataagtgagtggttttataatatattttatttcaatagtttaatacacatactttttgataaatcacaataatatattttatccatatgaactaaaaggcaatactttgaatagtagaaaaaattaaatttccctgcattatagggtatctaaccttttcaactaattttttgagctactgagccatgatatttttccttaaaaagcatttttagaagcataaagtaaacgtaggtgataaattaggtgtacacacaggcatgtattaatgacagcacccttctccagaactttaggatgtttcacgagtgggacatcatctctcttaaattactatggagaaattaaggattagtttctcatgatgttaactgatttctttaatcagctaggggttggcatttggcattatggtgtgcatgtgaatcttgggtagaatgcattgtattgttgtaaaatttgaattaatgtggacatatcttcctttctcgctgtcgtatagtaggaaaagttttgagcttacactttgttctccaaaggattcagatgtgtttggtcatgtacaagtgactcaggaagagttcacggcaggagagagagtttctaggtgttcaaattgggtcccaggataataagttgccgtgaaagaccttgcttatgtgcctttctttctccactttgtccctgcctgacccataccagaggcttgtgttggagctcttaaaagggtagacgacagtaaaatatatagaaaaactgtttcactaaaggctctgtgagattttgcagaagttcagggcagcctataccgggtaagcatgctgggttgtataatataatgaaatgcggcccagggattgggtgtcataaaacgataacctttgatcaagctaatatctgaaacaggagtgggactcctgaaccgtgaggcacatcagccgcatcataatcaaattagaaaaagatattatttttgtcacttgcattacctctgaaaaagataccgttggctacattggcctctttctgagttttgttacagatatctgagatagaagcacagccaaggaaacgttgctttatacttatttataaggacatttttaatctgcttaacatatagcctgtacaacataggttgtgtgtgtatacatatatacatacagatgcacacatttatatacgtatatatttgtatacacacacatctgcctggtcttctaattagaggggctgaaacccagtttcaggcataaaaacgatcactgatgtcacagtgctgttcagagagtgtcagtaaagctgaggaataacgccgtgcttacaacgcaaacagggcatcctgtgtggaaaacaaacaaaaattgtcaaatatcaaatatctaaaatattatccttcatacgttgttaattttgttacattaaactttcatcattctatttaattgggtatcgaatcaccttttaaaattcttaaattcttagtatttcaagctcttctggagaaaaaaatgaatgacaagtacagaaataaaatacaatcctcagcaggtgcggtggctcacgccagtaatcccagtactttgggaggctgaggcgggaagaccatgaggtcaggagatcaagatcatcctggctaacagggtgaaaccccatctctactaaaaataaaattagctggacgtggtggcacgtgcctgtagtgccagctactggggatgctgaggcaggaaaattgcttgaacccaggaggcggaggttgcagcaagccgagattacgccactgcactctagcctaggtgagagagtaagactctgtctcaaaataaatgaaagaaggaaagaaagaaagaaagaaagaaagaaagaaagaaagaaagaaagaaagaaagaaagaaagagagaataaaattctcaaatgaatcagcattctaatccattttcgattttagtagaagttgagaagatgtcccttttcaaaacctagcaactcagatattctacactaatagaaaacttagtactaactttgacttctgatagccctaaaaaataatacagctatatcagaggtacgtgggtaacaataaggtaatgttatcaaatacaaagtctttactacgttcaaaactgcactcaagtttcttttatctgttcctttgaacaaagattttgcagtcttttaggaaccaactctacctctataaagtattctgcttctgacctggtactgtattctccttgaagtgtttcacacactgattttgtgttgatttcccccctttcttacacccccaggatttttctcagttagatatgctgagtttataagtcagaaatttcaaggattattcctctaggctatcaaccaataagcacatacagcagaacagagggaagcaattgtttcatcatgaggaccacattgtgagtcctatctgccttcagagctaattgcccttgaactttgccatacttgcttgctatgttcctgttcccattcaaatatccatcttcctgcatcccacaacacctacccacctctgcttacctagtagtaatacagcagggattcacatgaatagggcactggtacatgtgaaaatgcacctggaataaatatagggatgggtctgcggagcctcttgctgctcatcgagcccagggtaagattccttgagctacgtcacacatcaccatcctgcagatatttattataatagaaaccaaaatctcctgttttattgcgtttcaggcaaatgacccattcatccagttgctactgttttaaaacacattcctccatgtttgtgttttccatggccacgagcagattgagtgaagtaataagaaattgtggaaataatttctcatcacatacatcaatctatgtgagttttcttccaggcatgttgctgagcattttggaaaattggttgataattatccatgtagtaaaagagcatctctctgtacatctttgatgggaattatgcaagagaggtcatctcattaaatttgatctagctaaaggtatctcggccttaaaagggtggaagtgaattttgcaaatcaggaaaaatagtgacgatgtatggctcacaggtgcttcattatttgaaaaacaaacacaacaaatgaggtcaaatgttaactactgagcttatagataggatgactatattacatgtgtgaataatgaaataactagtcagaacttctaagctgagataaaatcacagtgtgagaaaagcctgggatttttgtagcatttagttgtggccattcacttgattctaattcaatcgttgtattactcggttttcacgctgctgataaagacatacctgagactgggtaatttataaagaaaaagaggcttaatggactcagttccacatggttggagaggcctcataatcatggcagaaggcgaaaggcacaagccacgtcttacacggcagcagacaagagggaatgagaacgaagcgaaaggggtttcaccttttaaaaccatcagatcttgtaagatttattcgctaccatgagaacagtatgggggaaactgcccccatgagtcaatcgtctcccactgggtccctcccacaacacatgggaattatgagagctacaatttaagatgagattgggggggacacagccgaaccatatcaatcattacattcagaaatatattgaacccatcagttaaatcagttccttagtgtgtgcatacaagacatgggaagatgtcctttttcctctttaagagttttcaggggtcattgcaaacaagagaccctacattgtctctacaaacatggcgtgtggctctttttatctcatttttttccctctaaccataaatacctcttgttttctagggggcctttctagtacacgtgtgtgtttgtggcacagggagaagggtgcgaagagagaggagattatcaattaggctttaaatcttacactaatttaaatttatggatttcatcaactctgaaaaaaatgaatcatttcaaagttgtcagtaaataagtcatgccatgttattactaaagttatgatggcattgcttggatattaagtctatttccggatacaatttaaagagtgatgtgaatttctattttggaaaatatataactgtcttccattgatcactgccattaggtgagcaaggattgccatggacatgggactgcctgggaggctgactaggcaagagtaactggtaactagaagtgggtaactctccctcctttcctatatcactactcttttccctccactcctgtctccctaagtttacactccctaacaaaagagtagcatatgccaacacaacctttgctttatggggacccaaattaagacaatggcactaaaatttattttgcaccttgcacttgggttcacagccaaagtgcattgaaaaaaacatagcaaaattttgatgtgataattaaactctcctctgtgttactgaagactttcttatctgggtcatggtaaagctgcatcataactgcagtcttatgggtcatgttaaaactgcatatatcttctcacagagatggagacatttataacatctgcctggtggcttgcccagccttgattgcaaaagggaataaaagcaccttagagagtaacaaagatgacatgaagttttgaaagagaaaaagagagatgggattgattgagaaataatattctcataaaatctcagtgtcatgaaaaatatcaaggatttcagcaaagccttttacaaatatagactcatttccatggaatcagagcaggctcctataaagccttcagcctttttaggttagaggtggaaaatttgggtgcagaggagaaacccctaactatagagcactgctctggggccttggggatctccatacacatccagagagggtcagaaatttgcgaaagatgaaggcttgcactgtctccatcagcagcttctgttaggaaagagacgagtgagccaggcaagggagagcatcatgaacccagggggcggcttgagccaagcagtccacaaggccaggtggcccataggcatgtgctatgtctattataaaagccaccacagagtccacggtagattccttgagaaataatggctggaatttaaaaccataactatgtcttaaggcacagagatactacggtttttcctccaggaagagcagtataaatctgtgttggcatcatggtaactttaaaatacatgatcacggtcagagaaggttggggccaaaggtttctaaaacaattccttgtgactccttgctgctgggaatgcaggaaaatgtgctatctgtccagagtaggcttagttcttagagtaacattctgaagtttcaaaaaaaaaaaaagtatttgatggttttgaattccagggagtcaaaggaagctcaatgaagttttccatgtagcctcttcattcattctgcagtcagtgcaaatactttgcacaaaggtttctgcaggagaagtggaatgaagaagtcagctgaggatgatcagatacagcagcctcctaaagtagatgccaaactagcaggtgtagggcagcgtgattccgcactcctccgttgcatgcatggatagatatctactattagaaaatgtaaatgatgattgctattttccccttcatatttgtgaaaacaatagccagtagtttgttagatgacagatagatgaggatactttgagacaagaaaagcatggtttgttattatggaactgggttaaaaggctatgctaaaatattgagcaaaatgtaaactttagtgcattacaaactgcccaagccattttaggctttcttatcagtattacaaagataaatggttgttttcacattttccccagtcagatcaatattgtatcaagaatgtattcggtaatgcttagttgccctcaaagggttattgaaaagaataacaaaaatgatggctgtgaaccagttttgtagaaatatgtgtactatactaatgtcggttattgttatttctgttacaataatagttttgattttaacccaatcttaaggggaaaattttagaatatgaattgcagttattctcagtagcctaactacaccttgcgtgttagaggaatcccttttcaatctcattctgctcagtcttgctattaaatacttggtaaattgagttgagagtgtgctaattgaatttgcggacaatccacagccaagagtaaatgctttaggagagaactgaagtataataggactctgataaactgtaggaaataggccaactgtccaccaaatgagatttcctaaagctgtctacaaagctccaaagcatacaataaaataaaatgccaaaaataacaaatgcatttatctctaagcaatattatacacgcacacacacacacagaattttcattcttctacatttttgctaattctaaagtcaagttttctgccgctccattctcctctttgtcttctccatgtttctgagtatttctcctataccatattttctcctttgtgactctccctatttgagttaaaatgtgattctgcatagatcggattagctatagtgaagagcagcattggctatttctggaaaagctgtcacatggttccaagcttagtgccacaagaagatcaccaggaaaaccgtaggcctttccatggatcatgggatcaggagagccccacaccatgagcctgacacactcgggaccaagggagggagaaaccacttagccatcttgttcatctgcacctctaacatcggagacttgattgttgctaggttcacttcttgaatcgtctcaccctttccctacagtccaagatcttcacttacatttcagtttcttgagatattgaaatttttgagtcagtgtaggatgttgccactgaatatttggttataatcgttgactgtcaattcctatagcactaaaacggttttggttttctttttttttttttaattttgtgtgtatctaattttgatctcacaatgtaaccacttttgttattgcttttaagggttatctttcaaggtcttttgataatgatgtctaacacttgcaatagtgaggccacactctcaggcataatcactaaggtgtgtgcaatctctgtctcctttttcactaaatctgacaggctcctcctataattatctaaaactagtactgattgaggtttctttagactaatgtgttttcccgaagagaattttgtttttaaaataaatgagagtgtgtagtagcaaaacaatccaccaccagatcgcccttcaaggaaggctgtaatgccttccctgctgaggtgctgatttgagagatagtctccagctctccgccatctacagggatagacagcttcctgtgtcttacttctggaccagagccagttttcagacttagaaccccttgattgaagaagaatgaggtctccaggaggaaggaccctgtaacaccatggcaagtggttataaggaatgattctctctgtccttccccagaagaacctagggccattaactcagcttacctcacactggagaatggacgttaaaaatggggaatgctggtaacaaagcctgacttgatattaatacctggagacctgaaacagcattagagtccctttgctagtgtgaggcaatatgaggggcagggagaaaatgatattctgttcaacaccagcctcatagtgggtccacatggtctgctaacccactcaagagtaatttttccagccctcaaatatataattggaatagacatatttggtattagttacagtcccacattggatcctttgcctacagaaaaagaacaatgattgtgggaagactaggcgaatgtccctgaaactagtctcctatacagccaaaatagtaaattagtattgcacctcagggtgaggagggggagaacagaaattagtgcccccccatgagatctgaaggataattctcatatctctgtttaactcaacagtctggctcctccagaaaccagaggatcccgaggatgacacatcatcgtctgaattgcagcctccatgcttacatctttaatagaactgacgaataggacctgaagtacatgctatgtgaccttgatttagccaatgattgtttttctatttctatcagaaaagagaatcctaaacagtttgcattcacatgtaacgtacaaaagtgtctatctacagttttgcctgggacaatgttaattcccctccccctgtcataacataatctgcagtgatctgaactgtcaggataacccgcagattatcacatttatccaccatatcacgttagtcagagcggatatgcaagtggctagtatgttggatgccttgtttggacatatgggcttcagagggtgagagatgaaccatgtgaatattcagaattcttttgacatcagtaaaaattttaagcatagtcacaggcatgccatgaaaattaaaagataaattatttcatcttacaccccatgaagaaatttcagtctctttgggttttggaggtcacataatccacacctgagaatactgatcgggcccatttattactgacaagaagggctgccagcttaaagtagacacaggcaagaaacctctgcatcacatccagacttcggtgcatgcagccctgccacttgggccactcagctcaggagaccctatgatattagagttttctgcagtaggaaaatatgccatgtggaatatatggcaagccccgtgaggaaatcacagcacaggcccccagaggtgtgaagcattgccaagccgtctgcagtggagaaggaaaccactgaagaaacaattcctggcatattactgggccctgctacagtaagagaacctgaccatggtacatcaagtgcagcatgtcaactggatcaggtggacccagaaaaaacgccatcatctgatgaaagtgatacattcaggatcgaatatgagcagaaccagcgagtacaagcaaattgcacaaccaggcatcccagatttccatgtttccctcatcacgcagcacctctctctcatgtcatacttatgtccctgtggcgggagagggaaatttcttgtaaatatctgacgggaggaaaaagaaaatccaaggttgaattatagatgagttgactgggagcgtggatgcaacccaaaattagagaagagctacccattacagcatgacttaggcatagccttaaaacactgtggtgaggaaatattcccacagtgggcagagtttcaggcagaaaagtggcccaatggtagattatatacagattcatgaacagtggcggatggcctggccaagctgttcagacacctggaagaagacatctaaattatcaaagacgaagatgtctgagatagaggcatgtaggtggccaaatgggcatgaacactaagtataaagatcacacattaacacctacaagagaacatccacatacaaacgacactagaccccaagtagacagaataacttggttaatggacgtcagtgagcctccgtcagtggccactccagccctggcacaaagagcacaactacaaagtgatcacagtgaaataaacggaggcgatgtatgggcttctgctcagcaagtctggtcaagctatttcttcaccaaacgtccaacttgctagcaacagaggcccacacaaggtacccaagatggcaccatctctgaagatgaccaaatggccacttagagaaaaggatctgttttactatggaaagagaaacaatgcattctcacagaagtagacatatattccatgtttgggtttgcctttcctactccaagggcttacagactgtttgatccactgtcacaggattccacacagcattatatcagataagtggatccacttcatagcaaagggcatttgaaagcaggatggcatgggatccatctttcatattacacaatatgcccctgaaagctgcaggtacagtagaacattagaaggcctgctaacagtaaagcggaagcaccagctcagtggtgacgttttataaagatgagtcacaatcctccagaatgcagcatccacattgcagcaaagactttaaatagcactgtgtcccaaataggaacaatacataggtcagataagccaggagcgaaatcagaagtgaacttgcttaccatcattctctgtaggcactaggagactttgggctttccattctggcgactctaggctctacagggttagagatcctagtcctcaaagggtagcactttcatcagaagacacaagagtcctattcagcaataagttgtgattgctgcttggccactttgggttccaagccactttgggttcactaggaagtagcagccaagcaaaaaaatcaccaactcggcaaatgtaactgacactatcatcaagagaaagtagggcttctgttccacaaaggggcagggaggatggcgtgtgggactcgggtgctctacttgagttctctcttgtccctcagaactgagagagtacagtcactaagctcatgtagtgaaatccgtccatggacaccagctagctctctttagtggcagagatggctgtagcttgagctaagtcatcttgtaaatggtatgtcctggtcataaacaagactagataggaatggaattgcccatctgtcattgaacctaaaaacaaaacatcaaacacaacatacttaaataatgtgccctactaacaacaggagtatttaatcaaccaccaataattccacctcatactgaggcttcttcctaatgtggaaggatgagaacaatatgaggaattccagagcccgaggtatgagatctatgaaattgaaaccctgagctccttctttcacccaaactgtgaaccactctttcctaaagggtttggataatgggagaacacatctatctgttgtaggagagcccgtaaacctcacaaggctggacattcaagacagcactgagcaggaggctgtgagttgctttagctgaagatgggagctgcctgacagctgccaagttatctactgccaaaatctctcctggatgcaacagcccagatgttagagaatttgtatttgatcccaaaactgagggtgccttgtaaatttcacatatagttcactaaatccttgcgtgtgtggattgagcgaaagaagcaatgaacttagagtcagagatcatgggcttaagtcttagttctgcacttaagagctggtgaaattcaatatattttttcactgacacacacaaaaattaattaaccaaccaaaaaaattttaaaagaagagttaatggaaaaacaaggaagtaaaactatctattgcagtacctgacagttagtagagctcaatgtctgctagttagttttttaggtgaatttcaattattggtcttaggctgatctctctctctctcaatctctctctctctctccccctccaccccccccattccccaacccctctacaaaacatgctaaatttctacttctaattctctttagtaaatagccatgcacaacctctattgttacctgtgacctcctgatcataaggagctctgctcctgctctccctcatctgcggttgggcgctggtctttaatgagctactgctctgcatgtaaacacaaccgtatctaatagctgaagcgacaagagcatgtggattagaagggttgtgaaaatacagattctttgatgaacttttctagtaatgagtatttcaatttcttatttcgtagtaatatagtttggttaaaaaatgaaaacacagaaatatataaggaggtaaaagaaagaaacctataattctattctccaaaggtgtcatacataccttatgaaatgtttagtatccatttttctattttgccatgcgtatattaatatatttaaacaaaatggtatcatttaataaattctgttccaagttgaactattctatctgtcaatataccttgatagtgaagacgtttatgaatcactcatatcttaaggttcttccattaaaaaaaaaaagaaaaacaagaaattgattccagttacagtaacaagaaaaacactgttaggatattgggtagctcatagaattagtcgaatttgaaaacaggttgaggcaggaaacaacgaagacaaagccagagttggaaccggccctaggaatcctgcccgggacctcgcagccctgcctcccagcccgtgcgactgccctgggccctgaccgcttgtcaggaccttgcctgcacttggaaatgcgatgctgatgagtgaagaggcagcgcttactgtattcgctcacgtaggaaaggagctgtgtcctagatagtagaggtgaattatcttttcatcagtctctcaagtcattttaaggacctctgggccttgagtgcttctcggtttctggcagtttgggggcagcatgaccttcctgcaaaatggccttatgcacgagtgaccctttaagaatcactgttggttttctaggtttatcggtgaagtggaccatgtaatctgtgttctattcttagccgtccctgggcctgaccttgggggtggttcaaggtgtgtgaaactggctcttcacctgaggatgtttcacactgatgagctggggaagacgctctgcagcaactcagaagaaagcacttagttctgagagtcagatatttttctctcaggaccaatttgattctgtgctgttaaaccttatcttcattatcaagtagcactgattaaatgttcaaatgctcatagcgccgctctaggaaccatacaaaaagaattatcctgcccggtaggactttaaaatcaaaatcagagatttattacttacaaggcgtcacttggcaccccgacacggtaagaaggggccttccaatcacctcgacgctgcaggcccttgagaacactggttcagttcgtggaagtcttttccgtttttctcttccatgccatttaatcccacaatttggggacagaactgagtatacggagaaaacacacattagatgtacactatgattttattttgttgatttatttcattttcatagaatataatacaacagaatctttgcttcattggttttgaaccaatgttttcccaggcaagtcgcactgggtagttatatacagcgacagtgactataaaagagtttccgtgggccttgtccattgtcacaatcacagcagtctcacctcgtctttttggctccatgctctttgtaagccattcagagaaaacctggaagcggttcttcaataaacctgcaagcagttcttcaaataaacctggaagcagttcttcaataaacctggaagcagttcttcaataaacctggaagcagttcttcaataaacctggaagcagttcttcaataaacctggaagcagttcttcaataaactgttgccctgtacactacacccacggtgactctgtgctctgaatacaccgacgtgaccctgagttttctgaaatacttttttatattattggccccaaaaactatgatattatcttggaaattccaatattttgatactcaagcctcatctgccaagatttatttttatacttagaagtggcatacacattctttactgaatgatatgtcctcattttggtttagtgctacagattacactatacctttgctatcaatagcttctttctctccctactgccatcacaataaaaacccaaccttcagaaaaatcaatgcaatcaaagcataacagaataggattgacggagttgtggttatccaaggagatttcagatatgtcaaaaataacatgataaggtttcaataattttgtgcccaaagtgaaatgctttgctgtgttgtggatgctccctcggggaggtgttttctttcattttttgttattgtgaaagttcattattcctatgcccagggtgtctgtgtctctgtttcttttttactttttctttctttactttttttttttttttttaagatggagtctcactctgtcacccaggctggagttcagtggcacgatctctgctcactgcaacctctgcctcctgagttcaagtgattctcctgcctcagcctcccatgtagctggaattacaggcacccacgaccacgcctggctaattttttgtatttttagtagagacagggtttcactgtgttagccaggaccgtctccatctcctgacctagtaatccacccgcctcagccccccaaagtgctgggattacaggcgcgagccaccgcagcccgccctctgttccgttttatataatcagtgacaaatagtctgagggttgagatttggggcatttagaataatttttgtctcctccatctccttaggaaagatgtctgcccttttctcctattggagagggacaccgtggggatctttgagcagagtcaggcaaatccatgccgaagaggtgggcccgtgccacctttgcacagcaaagtagaagaaaccattggcagttggtgggcggctgttgcggggaattgagaagtccgcctataacagttttggagctgccatattcttgggcatggtttcagactaagaataataagaataatagccctcaaaatgagggctgtggctcttcatcatactagctctgctgtctggtgtcagggatctgatactgccaccaagcagcccagtgctttatgaataggatgaaactcttcacagtgtgaaagcctcaggcagcactactctccacactgtcctacagaacaatgtcaagattatttatagtcttcaaaggtacagtaagcctttttattccattcttaagataaacaaataaatcacaagcactttggggtttgtgtaaacagatacaaaagcaacataaattacagaccgaaaacttaatttataaataggagctataaatttaataatcgataatcataagtaatttcaaaatgaaataaaaagaaaagccccactagagaatattatgcaaatttttattaaattatctattctattctacctcatttcaggtcttaagaatgtgtttttcttatccataatcataaatagggagataaagggagataaactcatttcctcattttttattaaattcacctttcctccttgggtggaattttatgagcatctagagtgtcagtttttctcccaacacactgaaatgtttatagtatggctatttacttcatcaagctagaacatttttctattaaacacacctcagtttcaaagttatacaaaatatacctctactttgactttttgatgtatttcaaactatggccttatctgaaaacttaaaatagtagtcagctattatttttaagaagtacttaaggtagctgtcaatatttaacaatatataaaccatttaaagagtcacgtacctactcattgcaattttgagcacctaatatgtgctattataaagtatagaatgatgtcagagtaactactatcagaataacctgccgtaaggaaaaaaaaactattttaatactatttttaaaatatttgaagccactggcaaatggccaatgttgggtagacaacggagggaaaacaacccttgaaagaggtggactatactgggtgatatttgcatttgtgtggtttttttttttttgcctcagggcaccaccttgtccacatcatatgggacaaccaggattgaagaagatagccacagtttacaagcttgaaaaatcagacagcagttagaggtctgactttggggctgttataggagcctgaaaataaggtataaaattccagaagagaggagcagcaaaggtgggagcccctcaaatatacatgtgaacttcatctaaacttttctttggctgctctctcaactatgtttatgcacagcatggtgactatcattaacaatactatattgtacatgcctatagtcccaactactcatgagtctgaagtggaaggatcatttgagcctaggaggtcgaggttgcagtgagccatgattgtcactgcactcaggctggatgctgtctctacgtaatactactaataataagaataaaatatacatgactttttaaacaaaaattacagtagtgtttggtggagtttgtaaccaatacaggcatactttagagatattgcaggttcagttccagcccacctcaataagagtatcacaataaagtgagccaaataatttttggtttcctggtgcatataaaagttatctttacactatactgctgtctattatgtgtgtgagagcattatgtctaaaaaacccaatcaatatgtattaatttaaaaatacttaattgctaaaaaatgctaataatcatctgagccttcagagagttgtaatcactttgcttgtgaagggtcttgtctcaatgtcgatggctgctgactgatcagggtggcgattgctgaaggttgcggtggcagtggcaattttaagaaacaagacaacaatgaagtttgccacagcaattcttcctttcatgaaagatttctttgtagcatttgatgctgtttaacagcatttaacctagagtagaacttctttcaaaattggcatcaataatctcatacactgctactgctgtgtcaattaagtttatgtaatattctaaaccctttgctgtcatttcaacaatattcacagcatcatcaccaggagtcatttccatctcaggaaaccactttcttggcttgcgcataacaaacaacttcaagttttatcatcacattgtagcaattcagtcacatcgacttctaattctagttcccttgctattcccaccacatctgcagatactttctccactttagtcttgaacttcaatatcatccatgagtttaggaatcaacttcttccaaactgctattaatgttgataaattgacctcctcccatgaatcatgaatgctcttagtggcatttagaatggtgaatcctttccagaaggttttcaatttacttttcccagatccatcagcggaatcactatctatggcagctatagccttatgaaatgtagttctcaaataataagacttgaaagtcaaattactccttgatccatgggctacagaatggatattgtattagcaggcaagaaaacacattaatctccttgtacatcgctatcagaactctcagatcattaaagtgcccagatggcccaaagcaatatataaatccaattcaattcgtatcaaattaccaatgtcatttttcacagaatttagaaacagatcctaaagttcatatggaacaaaaaagagtcataataaccaaaacagtcctaaacaaaaagaacaaatctagtggcatcacactgtctgacatcaaattataatactagcctatagtaactaaaacagcatgatttttgcataaaatagatacatagagcaatggaatggaatagaaaatgcagaaataaagccacatacctacaattaagtggtctttgacagagttgaaaaaataaacaataaaaaaagacagtaaatggtactgggaaaattggctaaccacatgcagataaataaaactggaccactatctctcaccatatacaataattaactcaagataaattaaagacataaatgtaaaacttaaaactataaaattcctagaagaaaacctaggaaaaactcctctagatgtgggtctaaacaaaaaatttatgacaaagacaccaaagcaaatataacaaaaataaaaaagatagatcagaattaattaaactaaaaagcttctgtacagcaacaaaataatcaacagagtaaactaatatacagtataggagaaaataattgcaaattatgtcttcaacaaaagactaacatccagaatctacaggaaactcaaacaactcaaccagaaaaaacaatcccattaaaaggtgggcaaaggacataaacagacatttctcaaaagaagatatacaagcagctaacaaacacatgaaaaaatgctcaacatcactaatcatcagggaaatgcaaattaaaaccacactgaggtatcactttacaccagtcagaatggctactattaaccagatgcagacaaagggaaaacttgtacactcttagtgagaatgtagattggttcaatctccgtggaaaacaccatggaaatatctcaaggaactaaaaatagagcttccattcaacccagcagtcccaccagtgggtatctacccaaatgaaaaaaaaatatttatataaaaagacagctatacttgtttgtttattgaagcactattcacaatagccaagtcacagaaccaacctaagtgtcccatcaacagatgactagataagttttatatatatatatacacacacacacacacacacacacacacacacaccatggaatactacatagcagtaaaaaatgaaatatgtcttttgcagcaacaaggatggagcccttctgagaactgactgagaagcaaaaaatcaaatattgcatgttcttacttataagtgggagctaaacaatgggtacacatggatatagcaatggaaataacagacagtcggaactccaaaaggagggatggaatagaggggtagaggggtgaggtttgaaagattacctattgaatacaatgttcagtatttgagtgacagttacaccagatgcccaatccccagcattacacaatatacctatataatgaatatgtacatgtattcattaaatctaaaattaaaaagataaataaaatatactggaaaaaagaactcaagttactaggtgctttgtctgtgagcagaaatattttgaaagaaattttttttcctgagcagtaggtctcaacagtgggctgaaaatattcagtaaaccaggctgtaaagagatgtgctgtcatccagactatgctgttccatttataaagcacaggaagagtagctgtagcatgattctaaagggccctaggattttcagaatggtaagtgaacactggcttccactacatttgcccctaccaagagagttagcctgttccttgaagctttgaagccaggcattcgtttctcctcttcactaagaaagtcctagatggcatcttctttcaataggaggttgttttgtctacactgtgaatttgttgtttagtgtggccaccttcatcaatgatcattacaagatcttctggataacttgctacagcttctccactagcacttgctgctttaccttgcactgttatgttatggagatggcttatttccttatctcatgaactgacctctgctagcttcagacttttcttctgcagcttcctcacctctctcagccttcatagaatcgaagacagttaggactttactatggattaggctttggattaaaggaatgttgtgcctggtttgatcttctgtccggaccactaaaacttctaacattaatgaagctgtgtctctttctcatcatttctgtgttccttggagttgaacttttccctcaggaacttttcctttgcattcacaacttcactaactgcttggtgcaagagggccagttttcatcctattttggcttttgacgtgccctcctcattaagcttaatcatgtctagcttttgatttaaaatgagagacatgcaactcttcttctcacgtgaacacttagaggccattgtggggttatcaattggcctgatttcaatattgttctgtttcagggaatagggaggcctgaagagaggaagagagagagagagagatgggggaacagactgtcatcagagcagtcagaacacacacacatcatttattgaccatttgctgtcttatatggatgcagtttgtggtgacccaaaacagttacaatagtaacaccaaagatcactgatcaaagatccccataacagatgataatttaaaagtttgaaatgctatgagaattattaaagtaggacacagagacatgaagtgggcacaaaatgttggaaaaatgtaaccaaatgagttgcttgatgcagggttgccacaaaccttcaatttgtaaaaaatgcagtgtctgtgaagctcaataaagcaaagcacaataaaatgaggtgtgcctgaatatatcatatatagtaacaagaatacaaataccagataaatgcatgtatacagatgcaaaattttcatatattacatgctacagcacaatattaactgcataaactataataatttaagggtgcatatggtaatctctggaataatttccaaaaatatataataacaatgcaaagaattgtagctaaaagaccacaaaacaaaaacaagaaacatgtgggacaaacagaaaccgaacagtaatatagtgaacttaaatccaaccataacaagagttacattaagtataaggtgactaagccttacaattaaagggtatgggttgtcagacagggttgaaaaagaataattttctttttgctttcctgtatggagactaccagttttaattcatagtatttgaattatctttcaatgtttcatacattttaattctcattttgatttattctttgatccataaattaagcagaattgttctgacatttacaatcatatgaaatgttttccttatcttttatgacaatttcaaatttaactgcaatcacataatgtagtctctgtgttacgcattttttgaaatgtattgaagtttactttgtgatttaattaatggtcgcattttgttaatgtacacctgaaataacacatattttctagtagtcagtttcagggtatgatacatttctgttcaaccaaattttggaattgtgtgattcaaatctgctatgtgtttactaatatttttctgttatctatggctaagagaggtatgtcagagtttcccagcaagatggcaaatgtgtccatttctctttgtccatcttccaatatctgctgcatatctgcagagcttgttttcttaggggtctttgagtggaaaattcctcctggtcatttaaattcttcatattcctacatgtaataatgcttttcaccttcaagattatgatattttacttattattaataataatattgctgctcagctttgttttgtctattatggaagcatctgtttgtgtccattctcttcagctgtttagccatgtcttgacaatagtgtatagtggttcttatttaatcctatctaaaaaacctcagattgttcaatttgcttagtccactctcaatttgtgtgatcatcgctatatctgaatttgtttaatacaagctttctttttatcttccacttgtttcacgttttctgtgcttctttttttctcttttgtaacctatttagaagaaggaggtagattctcaaattactcatttgtttttagggttttttttctacctttttatttccttttgtctactggtttggaaataatactcatctttatttctgtggttttacctgaaaattttcctacatacttaactaaataaatcaaagttggtatcttaacccctcccaaacagtgctaagaacttagagcaattaacactgatcagcctcctctcaattaatgttccattgttgtgcatagttttagttctgtttttgttccccatcacaaattaaacctttttgtaactatttcatatgaacgttttgggagtttttgtggtgcaagtttaccagtgtctttgttcaccatttcttctttttggtccttcttttctttagaccttccttctgggaccacagtccaccttctagatatacaatctttagggtttctaaaggtatgttggttgtaaaccctctcacattattttttcactcctgtattctgcatgcctatagccctcaataaataagagagagtcggtgctcaagtcactggaataatgagaatctctccacatccccacatcccacaacacactggaatttccctcagtcttggtgataccacccatagtaaaaggcaatctttttaccagcattaggcctaaggaacccatatggccagattagctattggcttcctccctagggctgggcatctgacctataaattaaacacaccatgtactatagtagcaagaggctgccatgctaatatgcccactttaaagtcataaaggctaatctcaagcaggttaatgatgctcagaaatcatatcacattttcctgatacattccttttcatactcacgagatggctgtttcatgccctccatttgctcatcaaatcttctgtacccttccccatcctacatccatctgatgacctatgccactgataaaacagaagccatcaggagaagccttccacaagctccctccaccacatacttgcatccccagcacctgctttccaatactatgcttgtcccctatttctgaactactcatgctgccgtttacagccacccactacgcaggaacaccaaaatatggcaaaagcactgctccctgcagcccttcccacccttcccatcgcctttcccagctctggcccaggtcattcccctcagcgtgcaaatgtgttgtcatttctcccatgtggaaacaaacccgctatggaccccactttcttctcttggttccaattatctgcccctctgctcagcaaaatccttgaaagctgtccgtccactttccacttccttgacttccttttctctttaacccagtccaatcaggcttatacccccactacaccacaaaaactgtgaagctcacaaatggccgcgccattgctgactcctgtggttattctgcagtctgcatgtcatctatgtcgtttgcagtctccatgacataggtgggcaggtcttcccttcctcactcagtgtctatggtcccaacctcctctagctttcttcctgcctcactggccactctttctgtctcctttgctggttcctctgtgtttctcagactttatatgttttgagtgtctctagtccggtccttgaatttctttcctgtgttttcctctgtgaagatcttattcagccgcatggctttaaaatcatctacatactgatctctctcaaactggtaactccaaccttgtcctctcataagactccaaagtcatttatttaattgcgttcttgtccttgccaccaatacgtatctcaaattcaacaggtccgaaaatgagctcccatgttaccctaatcctcaaaaataggaaaaaataaactgatctcttcggtcttccctgtctcagttgatagcaattccttccttctagttgctttaatccaaaattgtagtctccttgagtcttctaattctctcatatattcaatccgttagcaaacctgctagctctgtcttcaaaacacacccagctattttaatatgcccgtttctacccacgcttgcctctctatggtctattcccatcaccgacagccagagtgtcccctgttacactggccaggtcacatcgcttctctgcccaaagccctgcaggggcttcaggtctccagtgaaaggccaccatggtctgatcccattctgcctctgtgcccggcccgagcttcctgctacccgtcccctcactcctgatccgaccacagccactgccttaccacgctgggtacactccttggggccttggcactgtcgtggtgctctctgcctgttacagtccttgccaatatattcacatctgcacgactagagcctttatagtggtatcaaaatctcaacttcttagtgaggactccatgaccacaaaaattacagttgccccccacccctacttccttcccccactgccacagcacgtgttatagatatcaactattttgtttattgtctgtctgccctaggactttattccagagtcagtgcttgaccacggtttggtgcataataaatattgaatgtggcattatcatttttctgaagtatcatcacacacaatttaccagtattatcatcatggaagcttaatagaaatacaaatacaaaacaaaaataattttcgggaaataagaacaataatgtatttctaaatttctacctctgattctgtaaagctgatgaacaaaaccatcatctatctattcacccatccatccatgcctccatccgtatatttgcatgtaagtagtttcaaatacaattattttagtttacatacagacatttcctacttaggtagtgaaattaattcttgcttaggtgtttataatactcctatgagaaaattctgtttcattagtttacatttaaaattctcatctttataagcattttaaaaaatgttatcatctgcctgggatagagataggcagttgattcttatattcaacttaattgcattttgttgtcttattgtgatgtaaattacatgatattataatgcatctaaatatctgggaattaaatattcattagtgtctgtaaatcagtataaacctgtatctgagtattttgtatcttgaaaatacacctcaaagtaataccaaatatggcactgaatctaatggaacaatagaaaaaaataggagataaatataatgtaaagtatgtatcgtatttgtataattgagtattcaaagtgttttattatgaacatttccagagtcaagttctaaaatgttcattatcactgaatatgttgattgcagaattgaattacataattaataaaagatgataaatttcacaaaatcatataaaagttttcttagtcttttctaggaactaaatgtgttaatggtttcatgtatccaatgagattttttttaataaattgaagaaaatttttgtgttactgatcaattttttcataccttttactttttcagtcattaatttttatttaattatcactgagtcatagaaacaattcacaactattaaaataagtacgtttttcatgatgcctctttattctcactcttgattacttcacaagagtctcaggagagcagcagggaaagtgagaggtaaatgaagccagaatcgcaccacatcttccctcctgttgagcactggacaacagtacttgtgtgccttgttatggtagtcggttacaatttagtactgaaattaatgactaattgtgcctaatatattttcctggagattttagttgaagaaaattgctttgagttccaaaatattttcagggatcacttaacattaggtaactgggaaaagatcctgaaattgtccctgtggttaaaaaacaaaacaaaacaaaacccacctttattttccctaatctatttttaactttatatagcctaaaacactaatgggtaaatatacctttctgaacataaataataatatagaatattcactaaaaatgtaaccatgtgaggtataaattaaaagacattttgattaaaatatgaatcttgtaggagcactgagatattttggttttggatcacttgttttttaaaaatctaattcgatttgatatacatttatggaacaatgtgttcatccatggcattacgttaagtgctgacaagataaagacgacgtagtctctcccctcaataagaacttaaagatacttctctcaagttatgaaattaacctcactgaaaaaaaaatgtgatgaaaagtttacttcagacaagggattttgagggtttgcactacttctccttgagcataaactaatgggttttccttgagtgatccatattctttggccagaaatttacatttgacctgtgagacatatttagcctaagttataagaaatagcttaatctttctgacaaatcaagagcaaatatttgagtaatttttttgcctgaaatatgataggtgaaaaagacactcatctatgagttttcaatcattagataaatttagctgaaatgggcttccaaaattttctctgttagagatagaggaaatggagcagccacaaggaagcaacttcaagtatgataaaatcacttatattttgaaaaccatttttcaaattcttactatggatcagtgataatatggtaaacttgtttattagtaagctccctctacactgcaaaatcataaaatgtaaaattataaataaaacaatacagaatgtgatcttgctatgtttatagtaggaagttcaaaattaataaaacaaagtagctgtattaaggacataacagtaatgaaatatgtataaactacactaaaaagataaccagataggaatggctccttcaaatgtgagaaagtttggacatccaagtataagagctgtgggtttcagtctgtaactggattttcattcaagcaatgataacccttccctggcatccatttcatgactgaatgctaattagataccccaagtttaaaatgtttctttttttttttttaagagatggagtcttgctctgtcaccccaggctgattctccctcctcagcctcttaagtagctaagaacaggcacgcaccaccacaactggctaaattgtataaaaatttttgcagagatatggtcttgctgttttgtccaggctgttcttgaaatcctgccctaaatcaatccttccacctcggcctcccaaagtgctgggattataggcatgagccattacacctggccttcttttgttctttagtctttaatgatttctgaatagcctgcttagatcctctctagccaacacatgcgcacagaccccaaatttatgtaccgtaaaaaatgccaacccctaaatcaatgacctaaattaaaatccttgctatgcccttagccagctatatgaagatgaataaatagaatcagcctctcttggcattccctatctgtaatacaagtttgctgaaaaagttcatctaaaacggtagtcttagccccgggctggtgtgcatatggctctgtgtatttcctcatctgcagtggggccaaaggtgttcatacagctattctcgtgatgctgatgggaaaatttacaacaaaagacttttgaaatggatataaacataaacataaatgtaagttaaaaagttttggttatcatatatgtatataaatttttctaataaatatgagtaactatcattacttataatatggtaattactaatgtttttatatctagaaatcatatataatatgtaattatataacatataatattatgcacattataaattgttactatgagaagatatataagtatggttgtatataatagagttaccacatataaatatatatgttgtatgtaatagagttactatatgtaaaatatatgtttactataaaaataagcaaacagatagctcaatatatagttattcttaaaactcaacgactttgggccgggcacggtggctcatgcctgtaatcccagcactttgggaggccaaggcggatggattacgaggtcaggagttcgagactagcgtggccaacatggtgaaaccccgtctctactaaaaatacaaaaaattacccagatgtggtggcatgcgcctgtagtctcatctactcaggaggctgagccagaagaatgacttgaactcgggaggcagaggttgcagtgagctgagatcgcgccactgcactctcgcctgggagacggagcgagacttcgaaaaatcaaaaacaaaaacaaacaaacaaaaaacttcaacaactttggagaaataaattattttttgaaattctgcttccagaaaatctcttatttgctttacactagcttaattttttgtttctgaacaagaattttaccatgtgggtgctgcctgtttccagcagtgattctctacgagtggattaaaatagccaaccctttggataaagaattatactccatggtttttcatgtgctaatgtgcttagtaacaatgtaatgaggatcaactacaagccacatactgtgtaatgtcaatgacacgaggctaaataagacaacattcctacacttgagccactcatcacctggccctactgaccatgccatcttggaataaaatctccagttcttacaaatttgaaatccatacttgtttattataaatggattataattcaaattaaaacaaaatatgaaattccaccattatttttatagttaactttgtttcatttaaactcaaataattttcagttaacagaaatcacattaattactcaagcaattcctctgaacacttagggaccctgctagactgtggggataaaaccagctatgctcataagccacctctttgaagaaaaaaaatgttcttatatgtggtgtctgcaaattttgtggtataaatactcctactgcagttgatttcaaataaccacaatgtaaccaccagctcacaaaatcctcaaatatttaatgatcatctctcacaagcttgtattagccagctttagcagaccactagataaatcataaatatgttctatggtagtcttcatatcttagtagggagaaacaggaagacatctaacaggatcattattttagtaaaagttctacgggaacccaagaggaaggaatgctagaggccagggaaggctttagagagatggggatatttgaattgtgtcttgagggatgagtaggacttccccagggtgacaatggttctccaggtcgagatggtgtagaaacacgaggatgggatgtcttgacagaaggggcaatgtagtagaggaaagtgtgtagagcatagtatgtttacattttgcaataatatgagatgaccagagagatgggaggggccaggaaagaagaggtacatacagtaagaattggggatgtgaggcagagcggctaagaaggcacttgtgtgtcatattaatgagttaaaggggctttggtaacttccccaattgagtagggcagtgccatgctgggcttttcattttaggaagaacactctagaagcagtatagaggatactttggaggtgagaagaggggtggcaggatgacttaggaggcagctgcagtgcactatgaaaaaataaatgaaagcttgacctgaaatgttaagtttgaggtgcttgtgaagatcctttattatttaaaacaaatctgcccaccctaaagaacaaccaagggggaaatatggttttaatgataacaataatgatgtttaagtacataagcatattctcctcaatctgttttcccttttcattatgggactttgttgtcagcagacaaatcttattgccttccctttcttggtgtaattaagatagtaaattgagtggaatattccttttttgtcatatctctatattatgttgcttcaatcaactgaaaatgtatttgactctagatgtagtaacaaatcagatgagaagataagaacaaaagggcatatttgattcacatgcacattctgaccagtccagcattcatcaaattacatattttatggaaattcaatgatcttgccaaatgtgtaaagaaagtgttaatcttaccttaaggggcaggccatgttttgtacaaaaaacaaaaactgctctttcaaagctaattcagtgcacaaaaaatctgtgtactgttcttatcatacatttatctccccatccaaatctttttccccagttttgaactaacacttgcatatttccaatgtagtgaaaattatttatgctctgtttgaaatctacagtgtcccagcccagtggtgatgtcagcacacataggtttcaaactgatgggtcttagctggcttctagttcttcatggcggttgtagtaaaggttccatgcagaagttttaaacttcaggcacttggaatcttacttccttgtggcatcctgccaaaccccaacagatctactgtttctttaggacatattagcaaaaatattagtgggggcagaatctgaacaccactcatgtatatgcctgcttgtaaagcttcttttctactaaggataaaagcattcattttttattatcagaggagataaagacaaacttttatttgaaggacaaattttaaacccatgtgaaaattattttaagagcatgtttatattagagcaattaaactaacgaagtagtatatcatgatgcagttacaagctggtgattttcaggaaaaattggttccctactgccctttttgggtaaacttaatattaaaaaaaatttttttggtactactgttagataggtaaagccctgtgaaagcccccttcctgccaactggagggtccacctcagaaattcccttcacatgtgctccctgggccgccaggtctttgagttagcgacgctcaggaacagagaagtgcagagacgtatgcgtcgcacaatgctggactggattcagcttttcttttttcttttttgaaactgatgatttctctgtcacccaggcttgagtgcagtacagtggtgcaatctctactcacttcaacctccaccttccgggttcaagcgattctcctgcctcaggctcctgagtagctgggactacaggcacccaccatcacctggctaatgtttgtacttttaatagagatgaggttttgccatcttggtcaggctggtctcaaactcctgacctcaggtgatccacccgcctcggcctcccaaagtactgggattacaggcatgaggcactgtgcccagcctggattcaaatcttaactcttctaattattagttctgtaacctctcagagattcatgtcttcattaatcacatgagaataatattgttcagtttatatagattttgagaaaacttcctaatcaccagtgacaaatgtttgtcatttagtgaatactcaaaatgttactttacttagcaagtataattgctaataaactccagattgaacggaaataattgagttaaactttcttgatattttcaagtagctcacttcttattttgtcttcgcaaccacaacttccttgccctttctctttttgtgtcccttattctattcttttacaaagttacagcagttaaagcatggagattcattctggagaagaatcagttttgtgcattctcctatgttctctgctcgtaatggaaccgtctccaaactgcatgcaacattgcaaacgcacagtgatgctacatatgtgatttcatgggataatatgatagtcaaatttttcaaagcaccaggaggaagagaaaacagttaacctatggtaaaccgtgtcaagataaactgatcttcaaatgacaaaattaatatataggcaaatgttagaaagaagcaattcaaggactgattgagaagctgatggtcattttctatgtatcttgaaaagcattacaaactagtatgatattctttcttcttgctcacaagtggaaacttctcctactgttcctaggctgccaatttttttcttttttccttcgcaaactagagcccattctgcactctctctccctgaggtacatgtgcctttccaaactaatatctctcactttttcccttcggttatattcttgtcctgtcttatttgtcctggtgccttaggggaacctttcaacacacctcataagggccagggagtccaagaacaatactcacttttatttccatacactccatccttcatccaaacagtcagttctaaaatatgttgaacttcaggtttaccagtgctgctggcagggacaggggagaaggaagatttgccagggagatttcagaagcacacagagcaagagggcagggagcgagggagcaccatgtcttggcttctcacctccctgtgtacgttaaacatcatgatgccagtttcttcagctctggctggtgacagtactggttcaaccatcccatgctttccccattctttcccttgtttgtcatcattgttaaccttgactttgggcagagacttcactatacaaaagctctttacaaaggaaatggatacaatgaaagaagagttttatttttttaagcgacgttgtagaagcaaagaaggtctagttttatctcccttccaccttttccgttctcattcttattctcatctctctcaggcaccatagacccatcagactccttccttgctgcctccctcacagggtcatgaagttttccttgtgcctggccccacagcacttcatgtttctctactgagaaacatatctaggacaagatacagtgcttgccttacacatatcgtatcctcaagattggtcaaatctaatcgtgcttttcccacatactagacataaattatttgagggtagggattgaatcttctcatctgtccataactttcagcactgagcacactgccctgagcaaggaaaatgccctatacattttagttgagttaaattgacaaagactgtcgttttttgctttgccagataaggataacgaaaagtccaaatccatcatgtcaatctcttcattaaagttcccatttccttaactaattctaattaaggcattaaggcaagtatagtggtaaaaatccagtctttggagccagaagaaaaaggtgtaaatttcagtattcagtagaggcttaggtctccacatctgtgaaatgaggtaaggccgtcttcatggaaatgctgtgcagaatggaagggtttcatgtactaacgtgtatcccaatcccaggagggtttatgtgtagaagaggaactggaaacagcctagtacattcacaatagaggaacaattcaaagggtgaggtctcattccagaaactcagctggatccctgtctcccacatttaaacacttgatttccctctcatttattttttcttatgtcacttaagatattaattacaaaaagcatgcagtacataatttgttaggatattttctaccaagtgggcctaaaaccagacttaattgaaaatgatccaaggttcattttccatgaaatttttctgagataaagcaagagagcaaagaaagaaagattaaatcatagaaaataaggcaaatctacatcgctccctactctgcttactttttgcataactccaaggttatgagcaatacaatgctgagaacctgcaaatgaacaatttggggtgggtgttcgctctatgtgtaactccaacagggaacatctaacatctttttcaaatacttaagcgaatttaaagaatcatgcccaagggttgactaaagctattttattgtaaagaattatttaagcagctcttattcccactcagtgaagtcaagacattctaaaacataatcttgcaagctaggttgagtcattctgccaagggggctactgacaggatatattcttgaaaatactcctttatcaaccctataggaatgctgtgcaccctttttgattatcacaaatttgtgtttaaaatcttgatatttatgtactatgtactttgaatacatgagcatgatactttaaatttgctaaagtatttgaaaaagatgttacaggtattcactgttaagagttaaacacagagtaaacacccattccaaattgtccattaacagctctcagtattttattgttctttggtattcttgtatataatatgatatatacgaacaggttaaatacattagttctttgcttttgtaagtaactcattacaaatgatttgagaaaattaaggtagacttttacatttaaagcatccttaagagatttttaaagtaaattgacccagaaggtcctttaaatggaaacagttgggattctaaagtaaattgacccagaaggtccttcatatggagatggtggattctaatgcagacactggaaagaatgtcaagggagctgtaatcaaatactatattttggctgttggtaatttactgaacagttgacttttggtaatttatgccaaaggtgctttgatgtataagtaatctattttcttttcacttgcagttcaagtactttgggaaacacattcactatttcagaccattcaggcagcttattgctgcaatacctcagggaacagtttattctttaagaaaatttggtggagtgttcttgaatttttgttttctaaggacctctgtacctataatctaaaattttagtatctctatttttctagaataaaagataccatgcactaaagccaccagttcaaatactcttgtcaccctaagagctcttgaaattgcacctggcggaaagcatttcccagctaactggaaataaggaagagttccctttcccttaccctgtttgttcctgaaatgctcaagaagcttcatttctaccttcagaaaacaattgcaagactgcttgtactttccttagctgttgaagttcctatgtctaaggatgtaaacatttgttttgagacagtatttcttttaattatatatcttagaagagcaaatagcctacctagcatatttaactcaatcccttcagaggtccccagtgagaatttatacacctgagccctaaaagtctggggtcattcagtgtttctgaagggcaggcaggtggatatcaagtccacatctttttaggcattacttttaattactttaaaagtaaacacacttcccatttgagttgtgtttcttccactaatgagataacagagcagtgttcctaggacactggctgctcctcagtgatagcaagtaaactgcacaagctacatctgtaattggttttctgatccagcctcagcaaacacacgtgagtgaagttcatggaagggataaacggatttagttaccttcacgagctaccttcaaacagcagtttaattttgtttccttatagcagcttccctcccccagcccattagagcttcttgatttatgatacagtagttgtagctttcccaatcaagacaggattttctcctgtcagaaaatgtggctccctaggataccgccctgggagagtaaatgagattctaatagttccagattatcactaaaggcagggtcaaggaaataacttttattttctttctattaaccgcacatagcaatgaaaattctcaattaataggttaatttatatgatttatagttcaatatacagaatattaatcatgagacattaaaagaaatgcttcctgttaatatcacttttctatagtatctaagtcgctttataagctacatgatttgttacaattaggcaggcatgttacttatgaaggtcaacataatattggaagggcccaagggccatttgtttttactaatactgtacaattttcacttaatatctagaatttgcttccttggtcttacaaagtcaaattcgtttacaatggaatctgttgctattttttgagtattttgtgtatcagagcctccttgtaagtggtttgctatcaacaaataatcaaacaatgacaagctggaggtcattacccttgaaaaacttcattggtttagaaattcaattcaaattttgtaccttattgttatcaataaaatttatggctaaatagcagtaacattacatgtgggatgtctacttgaactaagcacggaatctgttcccaagatcttaggatctaaaaggggaaaccaacaagaagctagaccatttgcaacacaatgtgaccagcggtgcaagccatgtatgaacatgcgtcctgatagtgccccagctgggagtgtctctttgagtgacctttaggccagcacctcctagatacttggtcattttactgggaactccttaagttcagtcactggttacctgcataattggaaaagagtttttatggatgactttaggagccatagcagagaattagctcctaaagtcattcttgactcttctgcaatcagaaaagcaccatgattaagtaacagtctctatgatgaagccacctagaacaagcagatcttgaagaggagtgagtctagaaagtgaggttagtttttggcctctgtggagaagggaggtgctggcgcaacccttcacctgcaccccagttatgtgtatttccatttctaggtgcaagaatggccctgcagcatgtaaagaaagtctacgtagaaaatattttaatttataaatttttaatctaaaaaatgtatgttattctccattacaagttgtagggtgggatatttaatcccacagattttactctattgtgtattagaaaaacggagaaggttaatgccctagatttaattcagatgatttaacatttgaagttcctatcccgtgagttctgttctttgcatgagagagccagtgcacacacacctatgttaatagcagcaatattcacaataggcaagaagtggaagcaacacaaatgttgattgacagaggaatggagcaacaacatgtgatatacacttacaagggaatattactcagccttgacatcatagaaaatcctgtcccatgctgcagcatgagtgtaccttgagaacattatgctaagtgaaataagccagtcacaagttgacaaatactgtacatttcacttatgtaaactatctaaaatagtcaaattcatagaaacagaaagtagaacgctggttaccaggggctaggggaggaggaaaagataaattgttgtttaataggtacagagcatcagatttactagatgaaaaggttctggagatctgtttcacaacaatatgaatacatttgacactactaaactatatacttaaaaatagttaagatagtaaattgtgttatgtgctttttcaacaaagagatagtctactgttttcacattttaaaacattactatgtcagaaatcttgactattgaaatccactatatatatagatgtaggctcgaagaaatatagtaccaagtaagcagtgcatggcacacatttctgtcacgcaactttaacagagggcctgcagaaaaggcagtgaaaatagaccaaatatgatgatttaatcctgacctggaaaatgatttagatgaactcataaggttccctctttctcacttatctgataacaaaattgaaatacccttaaaaaggaaatataagctcaccattgcatataacagatctgttgtttggaaaatcagatctcataattgtatttggggagggaagaagggagggagggaaagaaggaagaaaagaaaggaaagaggaagagaaggaaggaaaggagggaggaagacagggaaggaaggaaggaaagaaaggagggaggaaggaaggaaggaagggatggaagggggagggagggaaggaaggaaggaaagaaagaaaataaagagaggaggggtagagaatagagggcagaaagaaggaaaaaaggtaggaaatgaagcctggatgcaaaacctaattcttaaagaaagctttatgacattctcattattcctacagaacctgccattggaaagacacatattgcaaatgacgtggaacttacaaagaaggaaacaaactttctgagatctaaagtgtagttctagaggcccacgtatttcattctctgcaaatgaaaaccagagtgtttttattcattccgcatttttccctagagatttatttggctccagaggagacctatactatatgcttaaaatgattggtattaatgttgactttcagacagccaaaacgtttgagatgtaacagggaaggactggcaagcttcacacacgtaggcattattctatttgctatcatatttgtgtgagatatgtttattgcaaaatgcagattaccaagtgaaatctgggcaagtgtttcgaggcaatcttgagcatatgcttatggtaccagttaaaacattttagactgagaatgagaagggcttaagagagctactctgctgggcgcggtggctcacgcctggaatcccagcattttgggaggccgagacaggcggatcacaaggtcaggagttcgagaccatcctggctaacatggtgaaaccccatctctactgaaaatacaaaaaaaaaattagctgggtgtggtggagggcgcctgtagtcccagttactcgggaggctgaggcaggagaatggcgtgaatctgggaggcagggcttgcagtgagccaagatctcgccactgcagcactccagcctgggagacacagcgagactccgtctcaaaaaaaaaaaaaaaaagcgagagctactccaagaataatgactgtgaatatcagaaggacatatttaggcatgtttcattctaccagtgaccaagaagtgattatcctttacatggtcatttcactgagaaagacaacaaagaaaatggctgagaaaaaagatggttgataataaatagaatggaatgttggcacccacagaaaacaaatctagaattggaagactatgaatgtgcacatttttagattgaggtgagtgagactgtggggaaagcaaatgcctttcttgagtttgtgagtttgaatatctctttgcctctctgtactctattgtcttttaatctattaaagaaaatagtttcattatactttctccttttaaaaccaagaatagttgttcttttctttcctgatggaagaaatctgtcaaatgatagtttggatgtgtttgctgttttgatataaagactcgtcatgactagatgacaaaacagagcagcaatttcacattctcctatgaaagacttaagcagttgttttctgttgccaaaaacacccatacagacttaaaagcagatcataactttcgtagttacgggctttaataatggaaggggtgtggctatatctgaggaaaatatattttttatcttatctttatgatgcaggttaactcttttagtgaactttgcctgaattattatgctttttacttgattgcactgtatttgaagatataatttgtatttcaaatagcactcagcaaatgtatgttaaacattcagttctggcctggggtgatgtctcacacctgcaatcccagcactttgggaggccaaagcgggcggatcacgaggtcaagagatcgagaccagcctagtgaacatggtgaaaccctgtgtctactaataatacaaaaattagttgggcatggtggtgggcacctgtagtcccagctactcgggaggctgaggcaggagaatcacttgaatccagcaggcggaggttgcagtgagccgagatcacaccattgcactccagcctgggcgacagagcgagactccatctcaaaaaaacaaaaacaaaaacaacaaacaaacattcagttctataatatttgttgaaagctaacactatagggaaggatgttttgtttttgaaattttctctcactttctattttttaattgctaggaaattacctgactgacagaacactttctagtgttttttcttagaattacataaattacagaattgaattatttccgttcaatacaagctaatgtaaatcttgactccactcaggaagttaagtagcagtgttctaggtatttacgcttcatcgtgctatctggagagtaactcatacctgtcctgaacagaaaaaaaatagtggtgatacaaataagatgttgtataccacttttaacttttcacagttttttcttgtgtgacttttaattctcacaacagtggtgtaaattaacttgggtgtacagtgaaaatcaaagtgtttaaatgcctgagcttgcacacatatgtagtcactatggaatccaggattttgtatttaaatgggaatatgtactcagctaaggctcagggaaaaacaaaggaaagctgatatacaccaggcgcacatacacactgacacccaggcacacacacacacacagacgcccaggcccgcacacacgctgacacccaggcctacacacacgctgacgcccgggcgcgcatacacactgatgcccaggcaaacacacactgacgcccaggcccacacacacacggacgcccaggcgcacacacacactgacgcccaggcgtgcacacgcactgacgcccaggcacacatgcactgacgcccaggcgcacacacgcactgacgcccaggcccacacaaaccctgacgcccagacacacaaacgcccaagagatttcgcatgtaatttgcaatctggctgtgtctgttctcagtttggagtttgcatatatccatacttatgtttgtaatcccatgatagactttatctttttcccattactcttctcaattctttacccttcttggatgcgtaccctttgccatttgactagtgacagagcagacttgcctgctttggtgcggctgggcatggccgtgtgtttggctcggcacatggtcagtggatgggtgttagtcacagtgtgccagctctgagcatcagcgctgggaggcattgcaagccacagagctgtccctattcttctggtcttgggtagcctgctggtccaaggagaatgaaagacaagtggagcgtaactacatctaatatgaagcttggagccagcctggctgactcagtccaggtcagctggctcccagatgaccccagacacatggaaagagtgccaagtgtggttttaagatgctaagttgtgggttgtttgtttcctggcactattgttacactagctaatatcctacgtattatgtactatcagcagccatgaaatatgttctaattcatacatgattgtgaatcctcatgcaaaaaagctctttttcttttctattcttagggtatagtaaagtagcctcttggatccaaataaagtgagctcaataatattcattgttacataacaaatagccacgctaagaatgtgccatcataatttaatcacactatactgatcatcaggattcttctttacaaaacagagaagataataccttttcattccaccccttggaattcatttgttcatttactagcttattcaattattagctgttgagaacctcttattttcctaggatataccatggaataagataaagcccttaatgacacaggcttctaatctattcggtgacatagcaaaaggaatggctacttttcaatacaatgaacacgataatgaagctaagttcttggtagtgtaggcagacagtggagaatattttaggcagggaaagcaatatttgagttaagccttagaggactggaggaggggaggacatacaaacttatattctcataagcttaataagtacaattagaaaaaaaataacttgacactagacaatctgtttaaacaattttaaccaaataatcaaggttaatttaactaatagtgagacaaatgaacgtcttctacctcctgatccgaagcactgagaacacagtattacttatgcagtgctttttgctaaaaatgcataacctgaatctaatcgtgaggaagtagctgacaaatctgaattgacagacattctacaaaataactggcctgtacccttttaaaatgtcagtgtcatggaagacaaaggaacacggtggaactgttccgcattagaggagacttaacagcacgatatcttaatgagtttgcagcataggacgtcattgggacaattggcaaaatatgaataaaatctatagggtgtataatagtattatataaatgttgattttctaattttgatatttgtactatggttaagaaacagaatattcttgttttgaaataaacactgaagtatttaggagtaaaggggaaaaatctgcgtgtatgtatcagaaaaaccaacacttcttcttcccttgcacagtcaacacaacagaacgttctgtgaccaaagtgtggtggatttctccaagccaacaactcattgtccagcagacaccaactgggtgtcctgcaagttatctggatcctgacactcgccggagtcagtgcagaacccacaggggaagagcccagtcttgtaagatgccctcacttcagcagcccatcgcaagtcccacgtggcgaccttgtgacctgtgcttctgactgcccagctatccacagggttttctggaccctctcctcaggtttaatagtttgtgagaacagctcatagaactcaggaaaatatttaacttatatttacctacttattatgaaggatacagatgaacagccagacggaagagatgcacaggacaagacgtgggaaggggcagagcttccatgtgtctccgggtgcagcaacctccaggcacctccgcgtgttcagcaatccagaagctgaatcccaaccccacagtgcaggggtttttattaaggcttcatcacataggagtgatgggtcatcaacgccatctccagcccctctccccacttcctggaggatgggtgatggggcttaaagttctaaacttctaattctggcttgttctttctaggggccagtgcacctcacccccagaaaccccccaagatttgttgcattcaaataaaagtgctcctgttactcaggaaattgcaagggatgagaaactctgcatcagaaacctgggtcaaagaacaatgattagaaaacaaaatgcacctaccacccccatggctcaaaaaaatcaaagggttttaggatctctgtgccagaaaacagaggacagagaccaaatatttattttgtattgtaccacaacatcactgtgtgtgtgtgtgcagatggataaagaggaagaagtgtggatagagcaaatgtggcaaaatgcaaatatttgaggaatctgggtaaatgatatgtgtgggaatttcttgtataattcttgcaacttttatgtgattctgaaattatgtcaaaataaaaattaaagtaaaacaagacaaaaggatggggaaaagggttgatcctagggtaaaatgatgacagaattaaaggtaccagaaatagtatgtatcaagtcgtgggtacatgcccaaacttgacatggaaaaataaagactaacggctctctcttttctgcatttagatgcagcattttactgtactaacttttctacatgaaaataaaactcacaaaatcagaatgggctctgaaggttgtaccaatgtcaatttcctggttttgatattgtgccataattacataagctgttaccattgggggatactgggtgaagggtacacaggacctcctagacatttctttgcaacttcctgtgaatctataattacttgaaaatgaaggtttgggttttttaaaaatacttttctaactcccccatacaaaggaaaatttattttgttaacctcatattgatgtgaataacttcgtgtactgagacttttacctctaaacaggactaagatttttcacatttatgttagtaaaaaaaattagtaaattttaaatttagtataaaatttccaagacccatttatttaatattccattttaggatggcagagattctctccttgactgaaatccagccagcctcctctgagctctcttctccactagggcccgaccttggcctatcaagacttgaacaaacactagcacagtttcccacagctgaaggccgcaaccctcaggtgaccccagtcccccataagtgcctgcctgagcaaactcaaggctgccaaaagaatttactgtttgttccagcccacacctgaagctggagcccctgcttcccagcctctgtgtgagggtaggagcctaacgttaactcatgtccagctttggcaaagagtacattttatttttatttgctctgtcactagggcatccacattagccatagtgctgcaggatttcacatttcagaaaatctcaagcaaaatgtaatcatagctcctgtgaattgtgcatctgctgtgacccagacattgtgctttcctttactcccacccattcctcatcacagccctgcaaaaagaaaacaacagcaacaccgtgcacaggccaagtggcttggtgatagggctagtacacggtggcggagactgcggacccagcgtggcacatcacgggatgtatcattctgctcagctcgtcaggctggcctgcaccagtgagcgctttgtgtgctaccaactgtcataattattgagctaaggagctcgataattatcagtggagaaaattccaaggctgatcatattagagctttacttaatttttgatacctgattgccgacagttttgaagcctgacctctccctcctcctctttgctcacatctgcgcaagctgatgagaatgtgtgggctgctgtcttttggcacccacaggaaggctctgccccaccagggaaccctcaccccagccccaccttcaagccaccacaccagtctcctttcctggctcgttcaagacatttttggatctgcctgggaattgctccctgatctccccaaaagctctcattatgtgagaaataaagcttttcctgttctcttggtgtatgtgtggaatcaccagtcttgacctctcaatcaaattttgtgtggggagtctcttgtacttcttcagagtggccacaaaaggatgaaccactgaaatgtttaaatataaagaaatctgtattttcaattcagttaatcttcaggccatagaatataacttgtctctcatatggagcttaaagttagcatttagttgacataaatgctccaaaattcacggtacacgttgatgctaatacctcgcacaccgtccagtaactaggcacatttcaactttcattctcaaagatgcaaagatttctggtttgtaaaagcagcttggaatgttctttctgtgaaaataacacatttacgaaaacacacttggtgtgcatttcttctgaagggaatatatatttctttatggagcttagaattgcttatgaaaacaatataaaacctgtccgtattctattatggccctatttataccttcattcctaataaatattttgcattcattactgacttttgactttgggtgtaatataaagaaaacataaaagcatgaaatggtggttacaattttcagttttaaaaagtcatcttaatgtttctttggaaaaacatgtctcctcatgaaaagaaatagtcaacaagttcatattttttagaaaaagttaaaagcacatactgccagaaaaactaaattctctcaaattatattaagcaaagacaaataaacttttatacattccttgctttagcattcccacaaatgcatacttgctgttttaaagaaaaatgatcagagagcacaagaaagttagtagaaagtaaaattttatacagaagtgtagctgcacatttcagtattaacagaagtcctgtaatagaattaccatgccatatttcaatattaataccaataaaaagaaataccagttttcagaagcagtataacagccctctgctgtaattgggccctccttagtgggagacagttttgactccctgttcttgatacacacaaagctgtaaatatggccacttccctgttcaaacccagaatggaaaagcccctgataagaaagtctcgcttagcatgaatttttaaattattatcctccagctatacttttcacctccatgcacagtatctatatcaaacaagctaaacagattcaatttctttcctccaagaatttgttcaggccatactcaaatgtataggctttaagtggggtgggtcagcaagagaacagccaacccaacatgggtaaatcttgtttatgagggtggaaagttttaatgctttacttgattcattgctagacaacctttccatccaagaggccactatttttacaggtagcttcaaagtatatcaaatataaaagaaacagaaataatataaagaaaataagaagccataaataatttcaatgtacttatttaaaattttattaagtagtcatcattaatttcttagatgtttgagagcaaaccgtgcataacgtgcctgagcgtaagaaactagcagtacagaagaggagatagaaatctgaatgcaaaataaataaaaataaataaaagaaatctgaatgcacgccggcaacagggtgtgatgagttcaattacagaattctctaccagacacagtagaactcgttagctttgccttaactacttacggtcaccaaagcagacattttagttggacatagaagaaaaggagtcagggagggcagggagagggtaaggaaaagggggtgggacactttttaggagtaaatggcctgtccgaagcacagaaatacggaagaccttgatagattctagacagtgtaataagagcaaactgttggcaagaggactgcgagataagactgccgggctgacggaatccatatacagagactggtgatggaggtccctggaaggccaattttctgtataagcaatggggaagtgtatcagtcagatttttttttttttcagagtcttgctcatcacccaggctgcagtgcaatagtagcatctcagctcactgcaatctatgcctcccaggattaagtgattctcctgcctcagcctcccgagtagctgggactacaggtgcgcgccaccacgcccagctaatttttgtagttttagtagagatggggtttcaccatgttggccaggatggtctcgatctcctgaccttgtgatccgcccgccttggcctcccaaagtgctgggattacaggcgtgagccaccgcacctggcccagtcagggttttctacaagaatcacaaacaattccagtcattttaagtggaaagacatgtaacacacaaagtaaaatattttcaggatctgtagaaggtctaaggagtaggtctgagattagcctcttggaatcgcattacacttcaaacaacacagactggagtaatagagctattctctctgaggccaccacactggaactatgctggaaataaggggttaaaactggcatctctgccaccaccacctgtcaatattcaggagcctatgtaacagacgctggctggctgctggaggaacatcatatttccatggactttcttataaacggcaccctccaaaactttcacagagacggactctgctcactcctgcattccaaatatctcatgagttcatcaatacagaattctagcatcaaaagaatctaggaagtgtaactgaactttccaatcttcccaaagagagaaaagatgcaagggagactgagtgaaccaacataaataatacagcagaaataccattaacaatgctatgcaaaaaaattgtatatttgaaatcttctaatatttcttatctgtcaatatagaaatatggatgtcatagaaaaggcataaattagaatagaagttttgcatatatatttctaacctgagtgcttatttataatatggaaatcggtttctaggacaaggaagaaaagagaaatcgctcttttatttaatcaggaaagtttatgaaaggcaggagattctgagacctctccataaaggaaaaggaagcttctttgcaaacaaagaataatgattcacttcagctctagagaaatgtatgaaggaagggaggaaaagagttgaaattcagaataagagtgtgattccattacctgaagaggcaaaagagcaggaggaaattggacaatctagggtgggtgaactccacagtatgcagaagctggtgttcttgcctgtgagggtgaggttatttaaagtagttcatcaggggaagacacagggtatctcccaggtccacgggaactggggtgtggaaatagtgtcaacactgttcattgaaataatgtgtcagctggaggggaatggtcagcctggaaaagcagaagtaaagttggtgggagttcagcaccatctgagcagaagtgaacccagaggcctccctaaagcagaattctttcagtacagcaggattgttgcagtgagcttacccaacaccaccttgatgacattcacactcatcacttttcccctcttgctataaaaagctaatacacagtcagtgacacagtgtttgacctttcagttacctgaacatcaggaagcacatgttgtgggtggggtgagaaggagacaagccctattgtgcatatgcatgtctatattatcttctatacataccttttcatgatgtcaaaagatctttcatctacagctacataatgttgaagtgtacagaaaaggaagctgagattgaaatactggagtgtgatgaatgaaacccagagaccaatgtcccaaacatagcccagtctgcatctcccacatgaaggaacccaaggaatgggtaggaatattgtgatactccttaaatcatagttaggtaaattattccaacacctgctacctaagtagcatttacccatgcctttcataggaaagagagtctgccaactatctattggaatagaaagtgaggcaggtggaagaatcttatttgtcagtgttagattcctttgcaatgacaaaaacacatctatacaggaagaaagctattttatcccaaatactgaatgcaactttgttttccttttgtcttattagtcacgtttccatatatccccacttaagtgacatgagatggatgggtttccacaaggatcagctggaggagtttcacatccatctggcaaagctgcatgaagataagcctcgtgttttccagggaactgcattgctctacagaggcaatgccgaattattcaattgctttatgaatatttcctcccattaacctctctctgaaaatttgctgatacgcattaagtgtctcttaaccaaaatgcttggaaccgggagtgttttgaattttttcagattttggaatatttgcatagacataatgagaactcttagggatgggacccaagtctaaacgcaaaattcattactgtttcatatgtatcctatacatatagcctcaaagtaattttataaaatattttaaataatattgtgcataaaacaaagttttgactgtatgttgactgtgatccgtcatgtgaaatcaggtgtggaattgtccacttgtgttatcatgttggtgctcaaaaatttcatatcttggagcacttcacatttcagatttttggattaggaatgctaaacctatattgccctgtgtcatgggtccctaacacaatccatttactctttacttatttatttatttattttaaaaatgtttactgaattcacactatgagcaagacattgtttggtacaaaagaccaaatttggtaaaacaaacaaacaaaaaacatgctcttatggctaagaaaaataagcgaggaataaaatggatcttaagatgaggaggatgatgaatgacaaatgtcacaattaatatatagaaggtactgtcacttcacctagggaaactgagaaagcttccttagctttggagccatgaaggatggctaacatttacacaggcataggtatgagtctcagtagagagccaagaagagcaggagcctgttgtgaaaagcagtgaattacttatttggctagtgggtaggaggcaggaaaagtaaacctgaagcctttggggatgtttgcaggtagctgtatctattgctgtttggtgcccagagtatatgactgtgtggcgtcatttaataatgctttagtggaacatttcaaagtagccccgcataaaatcgttcagcgtaagccagataatcctacctagtttgagaggcatttccaaactagactcctgggccaatttgccatattgctacattgtgctggggctaggatctgggccaatatgaatctagctttctttaaaccagttattatatctttgcatagtatgtgttgcatcctgggctgaaactgagccttggagggagcctaaaagagagtgaagaatagcaaggtctctaaagtcagactgcctaacatttcagttctggctggagactccagaataagtcaccaactttatgcaaatatcacctgtaaaaacaggacaataacagcacctgtctcatggagtcattattagaaatcactgaagtgagagctcaatagatattacctgtgatgatgacatttgagatgctcatggagttagtctgttctcaacattgctataaagacatactggagactgggtaatttataaagaaaagaggtttaatcagctcatagttctgcaggctgtacaggcttctgtttctgggtaggcctcaggaaacttacaatcatggcagaagttgaaagggaagcaagcccatcttcatatggctggcaggaagtgtggggaaggtgcctttaaacacacttttaaacaagcagatataaggaaaattctatcacaagaacagcaagggggaggtccacccccatgattcgatcacctcccactgggcccctcctgcaacactgggaattacaatttgatatgagatttggatgggaacacagagtcagaccatatcatgatgtaaggtgctggtagtttggctgacatttcaaacaaatctggctcaggcctagggtttgcagagtcacatgggcctacttgggaaattacaatagcagagcaaaccttctaaatacatttcacttccagaagctgcacttggatgaaatactgtctcctgaagctctgaaagtcccttttctgtgctgctcaaggaagctctaaagacaggttggttctgtgctactccaaatagctccaaagacaggtttggaacaatgacccataaaatgtccatacattttaggatactaatgaagagcaatactggtccaaagttcagtggtcagagtatgggtgtgtttgttttatttcagaacatctgtatagcattttcattgcttatacaatagcaggtatcttcagtattatttaaattgaacttctaaaccttctttgacaacataccacgtatccatttatacatacacactaaaaataagagggtgcatccttaattttaaatcagttgcatagatttcattgtatagatataattagtaattttcctgtttattggcatctcagttatttccaggcttctactagcaatattatcatgaataaattgtatgtatgttaaaaaataataagctcattcttagtccttgttgaaaaaattttgtgttacttttatgagcaggatgcaagactcagacaaacaaggcctaggtagctcatactttattctttttgcaacaacttttgaaaggcttggaatattctggttatagatgaaagatgctgttatttgctatttctcttcttctccaagtgaagttctaatgaaaccatgtgtggaagaaataaatcattggaaggtcaagaagcttcaaaaacaaagtttgaacaagttcctggtattgttgctgagtgttaaatattctcaacttatcatttgctcttctagctgcagttttgcacaaggaagacaagtgggagcaattaaatcctgcaccactcctcttgaattcaaggctgagccatttggacaaagaaaattggggaacaggagcaaagaccctcactgactgtgttcttttttccatgaattagaaggaaatttaagaaaatcactttgatcctttttctacctgtaatgttaaaaactgtaaatattttctttcattgagaattctgggatacagtagcagacttggtaaattttaaaccgaaaaatttatcagcgtttattgcacggacaaagcaataaaaaattgcatcatctaagatgccaagaaaccacatgtgatacagtccaaggacatccagaattcccatggtcctatgcagtagcttacaaacttaactctttttggaaaatatggacatacaatatgctgacgggcttcccattcattttaagtgtttttagtgcaagtctctccactctatgatttcttgataagttcctcataatgaaaattcttttgtcattatataccttgttagttctgattcttgtccttgggaatcaaagaatattagggttataggtgcaacatcactcagtcatttaggcaaaagcctttcattttaaagattaagaaagtaatctctgagcacacgaaaagacagtggagcattgcactttcatcttcatttcactcttttgcttgcaaactccttgagggtaggaatttgttttactcatcaataaatctgcagtaatacaacgtggagaatgcagttggtgcacaaacaatattgaaagattgtagatatctctgtccaaagtcacacagctgccagaaccagtggctcactgggatgagtcttgtgtctactgatcacccgttaaggatgttgcctctgaattattcctccaagggtttttttccccctgggatgaagaataaatatctgttgttttccttatcatgtaaaaaaagtgtatatgtttctgcaaatactagccaaagcatcctactttaaaacttctctttaaaattccggggagtgtcaccttgacaacaggcacagaatcttccaactgcaatagaaaattgacaaaattttttaaactcagtgaaaaaaataaaccccactaccagtaattaaataaacaaaatgaaacaattccttgccataaatttcagaagggcaggggaatgagaggagaaaataataataattttttaaaaaggcaaggaaagaagtagaagattgaggcttagctctgggaatctcgtaacctagtctccactctttgacaggtggtactgaggatatcaacagaattaagaaggaacatccaagactttacactaaataagtattcaagttgaagatgaattatcaccaggggaatagagtaattcatggtagagaatattcaacaaaatcgcagaaaagagtaaaaaacaggttcagtaaagatctactcttagtttagctttccccttcttacttgtgcctttcatagcctcactatatagaaatctatggctcagaagaaaaggtaaacaggtccagataagaagataaagatgttggggtttccagtttcatctcagacatgtaaataacctggaagtcattattcctgttcttacaacaataaaacacagaattaactgaaaataaatgacttctttgacccatcataaaattgaggttgcatggcgaaactccaccccgaaatctagaagacaggtaaatacagaaaatcatagtcaagatcagtttacccggagtggaagcccctgaagccatgcctggcatgcacattgagaagtgaccgggcaaattgctggaggctgagtgtggactgcatgagactgaaaaactctcggaactcatagtctcagggacaccccactgcccctgccacgcttttgtgattagacctccaaaaaaactctctctcctctctcttcccaacctaggttcttaaagtaaaaacgaaacaaaaatcctttcatgtttctgacaggaggagaggaaaagtatgtattttgaaatacgtccaaagcgttctgtataacaacacctactccatagaggaaaacttgaccatagccttatctgacttgtgaaaagggcaactaagcaactccagctactctagccttcttgtctcttctaaaggaaggttgggcgaaaaagctaagaaatacttttaagtcagagaccagggaacagattagggaacaagactaagatataattgtagagtacagaatgcttctgtagtcccgaaccttatcaccacctcagcagggcttccaagtaataacagtgggctgtaactgaaagagaggcaagatgcagactccagttaaggagggaagcagggtctaaagaagcccaaagacatcaggagagacaaaaataaaaacattagacatatttgaagcctctggaacctgaagctaaagtaaacagtaaacataagcaggattcctaggcagaacaacaaaacttcacactgaaggtctacttacctcagtttcaattctccaatacattaagtccagcttttcacaaaaaattttatgacatgttaaaaaggcaggaaaaaaacacagcctgaaaagacaaagcaaatgtaagaactaggctcagatataacacacactgtggaattgtcagataggaaattaactgtgatcaacatgttaatagttctaataaaaaaagtagacaaaaaacaaatgggaagtataaacagagagatggaacccctgtgaaactaccaaaaataacctgttagaaataaaaaattatccaataaagatgaaaaattcatttgacgagattatcaataaactggatttggcccaggaaaaattaatgagcttgaagatatgtcaacagaaactattcaagctgaaatacaaacagaaaagatttttaaaaagaacaaaattgtggaacaatttcaaatgtataacatgtatagttggaatatcagaaatagaagcaagagaaaacagatcagaagaaatatatgaagtaatagtggctgagaatttcccaaagttaatgacagaaacaaccagctacaaagccaagaatctcagaaaatactgaggggaataaatatatatttaaaattctattgggcatattatattcacatgatacaaaataaatcacaaaatcaaaaatgaaaaaggccagggaatgaaacattaaaaatattttaaaatatatgtctaaattacccacagaggaaagaatttcaaaagaaattacaaatattttgaagtaaatgaaaatgaaaatacagcttgtcaaaatctgtgagatgcagaaaaagcagagcttacagggaaatttaaaacattaagtacatatattaagaaagacagaatgtaacattaataatttgagcttccatgttagcaaactagataaagaatagtttaattctaaatcaagcaatgtaaataaaattagagcagagataatgaaacttaaaatagaaaacaaaacccagaaaatcagtaacccaaaaattgatctttgacaagatcaataaaattcataaacctctgactaggataactaagataaacacagaaaaaaaaagagtatcaataaggattcacccagtatataaatgcaagtagaacttctggctcaagctgccaaattttaaggtctctgaccttaaaagtatttcttagctttttcacccaaccttcttttagatgagacaagaagactagagtagctggagttgcttcattgcccttctcacaagccagataaggctatggtcaagtttttccctaaggagtaggtctcgttatagagaatgctttggacatatttcaaaatacatatttttcttctcccccgattagaaacatgagaggatttttctttcctttttactctgagaacctaggttgggaagggagagtagagagagtttacttggaggtctaatcacaaaagcgtggcaggggcagaaggggcatccctgagactatcagttctgagagtttctcaagtctcatgcagtccacactcagcctccagcgatttgcccaatcaccttctcaatgtgcatgccagtcatggcttcaggggcttccactgcaggtaaactgatcttgactatgattttctgtattagaaaggtgagaaaaagaaaaactatttgacaatttttcaaatataccaaagcagattttttttggagattagaaaagaatggagtatgcaaaatacacacactcctgtctggaagagtgaataaccagggaagagaagagcatcctgcaagacagtgtaataattaaaggaaataagaagcatgcaagttcaatcaaatacgttctgaaaggtaaaatcccaatgaaatgaagaggaatattggaaagctatcatcataaaacaaggaagaacaaaactatttttattaccaaataaattgggatgaaaggcaaaatgggcatagataagactaagtgatcaagtaaaaggaattttatagattagagaatacaaaataaaaacacaaattaaatcaattagagagtatttaatagagaggattagggcacaggctgaggcatggaaatagaagtggaattggtggccccgaagtaaagacaataaccacataaactttaaaaaaatgtaaagatatatttgagtagttttctttgagatgattgaatctgaagaacaaaaaatatatcacattgatttctaggaaaaactgatatagaaactgatatgcattcacctagtttttaaagtttaatattaaagtaaagaaaaaactttacagaaacccaggcataatatgtaagcaactgacacggaattttttcttttactgacttatactgaaaaatcttctaagtcaatagctaatgtccctagtgaaggatttgtaaccttcctttacacaggcagcctcattatagttcagacataaaggcagtagtcagacattctcaaatatgagagaacttagcattaggagaccaaaaaagtagtgaaaataaagaattaaagaaaacagaaatcatcccaaaagtctgataaataagaaacattcctattaaaaaacagaagcagaactagataaccaagatgattttggttataaaacagaatgccaccaatttataataccagtttagaccattctatatcacagactatagatacaataatataaataatttttcaaaagaactgtatttttaaacatataaaactttaaatttatattttaaaagcataaataataaaatttagcaattagataaaataatttcatcatctatccatgggtagtgaataagattcaaatatatttttaagtgattccattattatttttataattttacatagaaatttacaagaatctttaatggcttatatttttataattatacaattttaaaattttttccttttttaaaatttggtcatgtattcattattcactcagtcaaaataatattgagttttaaactgaacatagcatgtatagtaaagtcttctaacaattgatgattttcaactataacacacaactacaaaacctcagtggcaaacaacaaaaaagacctaagcttacgagtctgtgggttcagctgatacagtacaggttcagctcagctgagctcagtggctcaccctgcaggcagctgtgaattgcctaagagctctgctgacttctgctgggcttccttatgtctaggggctggcttactgctctgatatagaaaggtctcaaccagtatgactgggcaactccattctattccatgtgtctccttcttcagcagcccagcccagcctattcttgcggtgactgcagacgggaaagagcaagccagcctattcaagtaaacactgttcaagttttccgtgtgtcatgtttgcttatattcaattggctgcagcaaatcacaaggctgaggccatagtcacagggcaggtcagaccagtgttacatggtgaaagggcctaaatatagggaaagataaagaatggagaccagggccaggcacggtggctcatgcctgtaatcccagttctttgggaggctgaggcaggcagatcgcctgaggtcaggagtccaagaccagcctggtcaatatgatgaaaccttgtctctactaaaaatacaaaaagttagcctggcatggtggcgtgcgcctgtaatcgcagctactcgggaggctgaggcatgagaattgcttgtacattaggggacagaggttgcagtgagctgaggtcatgccactgcactccagcctggacaatagagtgagactctgtctcaaaaacaaaacaaacaaaaagagaattaggccatttaaaactctacatatttttttctctcactgagtacctattcatttaacaagctcctatctagctatctatctatatgcatattgagataaataaaatattctcagaagattgagtaacctaatataagtaataattcctaaacaaatacatttatatattgaagatacattaaatcatattttgacatccaggcaaccattatttaaagtcagaattggccaagtgtggtagctcacacctgtacgcccagcactttggaaagctgaggcgggcggatcacgaggtcaggagttcgagaccagcctgaccaacatggtgaaacctcctctctactaaaaatacaaaattagcagggcatggtggtgcacgcctgtaatcccagctacttgggaggctgaggcaggagaatcacttgaatccaggaggcagaggttgcagtgagccaaggtcatgcaattgcactctagcctgtgcaacaagagtgaaactctgtcacaaaaaaataaaaaataaaaacaataaagtcagtgttaaattcagattggagatccaattccagaattgtggcaagaaggactccacagacccactagtcttgccataattggtgaaagtctttttttttttaaagaagtttgttggttttttcttttttctttttaaaaataatttcaacttttatgttagattgagaaggtccatgtataggtgtgctgtattagtcagggttctcttagaaggacagaactaataggatatatatatatatatatatatatatatatatatatatatatataatatatgtaaaggggagttaatattaagtattaactcacatgatcacaaggtcccacaataggccatctgcaagctgagaagcaagaagagccaatatgagtcccaaaactgaagaacctggagtccgatgttcgagggcaggaagcatccagtatgggacaaagatgtaggctgggaggctaggtctgtcttgctgcttcatatttttctgcctgctttatatttgctggcagctgattagatggtgtccacccgattaagggtgggtctgtctttcccagcccattgactcaactattaatctcctttggcaacaccctcacagacacacccaggaccaatattgcatcctttaatccactgaagttgtaactcagtattaaccatcacatgtgctatgtgagtatattgtgtgatgctgatgtttgggatataattgatccagtcaccaggtagtgatcatagtacccaatggttagtttttcaatccttgccccctcgcttctcccgagtagttcttagtttctattgttgctatctatctttatgccacatgtccccaatgtttagttcccacttataagtgaaaacatgtggtacttgaaaaccaacaatttaaagtttttgaaaattgtcctaaagatatatagcaaatggagaaacttttttttatttttttattttattttattttgttttgagacagagtcttactctgtagcccaggatggagggcagtggggagattttggctcactgcaacctttgcttcccaggttcaagcgattctcatgcctcagtctttcgagtacctaggattacaggtgcatgttgtcacacccagctaatttttgtatttttttgtagagatggggtttttccatgttagccaggctggtctcgaactcctgacctcagatgatctgcccaccttggcctcccaaagtgctgggattacaggtatgagccactgggcccagccaaatgaagaaacatttattcaaggatgtctactcatcttggtaggaatagcaagagtctgacactgggtccacaacctactcttatctttctcacccccagcttagcatgacagaagctccactccaggtagacgtgatcaaaaaaaaaaaaaagaaagaaaaaagacagagtttctctctcctctaccttcaaactccataggaagagatatggtatcttcctgggagagtcaggagccagcatttcttagctccatctccctccctactttcagccctctattgcagaaggtaaatttcaagcaagtttggctaaaggttgggggctaccttgcttcatccagcccttattcgtaggacaaaggctctacaccaggtgtggcaggcccagaatattggaaccataactgcctacctccctgatcaatcatagggtggaggttgcatattgggagagacaagtcaagaagaccaaccaggggagtgaggagggctgccaccaccaaccaggagagtgaggagggtctgtggatggaaaattattaaaaggaacttgattaggggtacagggattcttgctcaacttgcttagcaagattccttattaaaactgttcttggcaagccagaggaaggtagcagactaagtttgaggcctagctgggaaaagggcctagaggagggtgactcaagtttggtcaaggaatgagtccttattagttgagagtaatatctggagacatcaataccccactttgaaaaatgaatgaataataatgcagaagaacaacaaagaaacagaatgcttgaataagattgtaaaccaatcacacctaagagataactacaggaattccagccaacaacagcagaatacatgttctcaagcacacatggaacatttgctaggatagatctatgccataaaataagcctcaataaatgtaaaaggtttgaaaccatagtttcttctccaaccatgatttttttctctaattttgaaattgggcattaaaaacagaaagaaatgagagaaagccataaatatgcagaaattaacatgtttctaaataattaataggtcaagaaaatcacaagagaaattaatatgaatattaatataaattaaaatacacaacacaccaaaatttatgatctactgctaaaatcttgcttagaagaaatttgtggatataaatatctttttttaaaaaaagatcattaatcaagaatctcaattttactgtaagacattggtagaagagcaaatgaaaccaaaaacaagcagaataagagactaagaaagatcagagaggaaattaatgacatggaggatagaaaaacaacagagaaaatccacactgccaaaagttggctttgaaaaggtctttgaaaagatcaacaaaattgggaaaaaaaaaaaaaacaccttttaagctcagcaagaaaaaatgagaaacagccaaattatcaaaaccagggataaaagaggatattattactgactttaaaagaaaacaaaaaggattataaggaaatactttggataatggagcaccaacaaattaggtaacttgcatgaaatggagaaattcctataaagatacatactaccaaaactaatgccatctgaagactatacactgtatgattccaattacagcctgtgcttcaaaattcatccctaccctgaccctaaactatggcaaccactgatttgttttactatctgtatagttttgcctcttgccctacaggtgattggttccaggagccctgtgtataccaaaatccatgtgcacttgagtcttgcagtcagcactggagaacctgtgtatctaaagtcaaccctctatatacacaggtttcacatctcatgaatattgtattttccatctgtgtttagttgaaaaaatacacacattagtggacctctgcagttcaaacccatgttgttcaagggtcaactgtatatgacattctggaaaaggcaaaactatagagacagtaaaaaatatcagtgcttgctgggagttggggtgggggtagggatgaattttggagcacagagaatttttagggccataaaaattcttcgtatgatactataataatggatacaagtcattatacattggtccaaacccacagaacatacaataccaagagtgaaccctaatgtgaactatggactttgagtgatttataatgtgtcagtgtaggattatcagttgtaacaaatataccagtcttttaggggatgttgacaatgagactggctatgtgtgagagcaggggaaatatgggaaatctctgtaccatcctcccaattttcctgtgaacctaaaattgctctaaaaaaaagtctttaagaaaaggaaagaaaatggcacatcaatatctcttatgaatacatacacaaaattctcaaccaaatactaggaaaccaaatccagcaacccataaaaatgattatacatcataaatgagaggggtttacatcagggatgcaaagtcagtttaaccttagaaaatcaattaatgtaatacaccatttcaaaggaaataaagggcaaaaaccacataattatctcaatagatgcagaacaagttttgacaaaatctaatttctttatgatgaaagcactcaaccaactagaaacacaagggaacttcctgtacctgataaagagcatctacaaaatcccccagctaaaaacacacaatggtaaaagactgaatgtttccccctgagaaaggaacaagatggtgatgtctacccttgctccattaattcaacattgtactggagactataaccagggaaattaggcaagaaaatgaaacttaaaatgccagaattggaaaggaagaggtaaaattatttccatttgtagatggcgtgatcttgcatatagaaaatcctaatgaatgcactgaaagaaaactattaaaactaataagttcagagtgtttggatatacaacatcaatatagaagaatcaattctattttcacacactagcaataaatattttgaaatgaaattaagaaaacaatttcatttacaataggatacaaaagaataaaatgcttaaaaatattaaaagaagtgcaaaatttgtatgttgaaactataaaacatgattgaaagaaattaaagaaagacatcccatgttcatagatcggaacatgtaatatttttatcatggtcatattccccaaattggtgtacatattcaatgtggtcattaagaagcttaacttaaaattcacaacaaaatgccaggacaaagaatagccaaaactattttcaaaaaagaaaaataaaattggaggacctacacatcctgattttaaaacatagtataaaaccacactagtaaagataatatggtgctggcataagaatagacatacagatcaatggaatcgaaattagagtccaaaaataaacgctcatgcttagggtcaaccgattttcatcaagagtttcaaggccatttatacgggaaacaactgtctttttaacaaatagcaataaacacctggatatctacatgcaaaataataaagttgggctcctccctcacatcatacataagatggatcccaaatggaccaaagacctaaaagtacaagctaaaactataaagctcttagaagtaagcatagaagtaaatcttcataacttcaggttaggcaaagtctactgaaagcataaatgacaaaagaaaaaaataggtaaattggacttcattgaaattaaaaacttttgtactttgaggccatccagaaaatgaaagtacaacccacaaaatgggagaaaatatttgcaaattatatatagaactttatacacacacacacacacacacacacacacacacgacttgtatctagaatatataaagaactcttgcaatttaacaatgaaaaggcaaccaatccaattaaaatatgggcaaagaatctgaatagaaatttctccaaagatgcatagataaccaaaagcatatgaaaagatgtccaacatcaatagtcaccagggaaatgcaaggcaaaagtcacaatgtcattcatgcctactaggatgggtataataaaaacgacagatctaagtgttgaaaaagataaagagaaattggaaccctcatacgacgctggtaaaatgtaaaatgatgcagcaacttagaaaaacatcgggcacttcttcctcaaaaggctaaatacagagttactatctgagccagcaatctcgctcttaggtatatacccaagaggaataaaaacatgtccccacaaaaacatgtacactaatgttcatagtagcattattcatcagaacaagaagtaggaataatacaaaggtcctttaactgattaatgaataaacaaaaggaagtttattcctacaacaaaatactatttggcaatagaaaataatgcaatattgatgtgttacaacatggatgaaccttgaaaacataatgctaagacaaaagtcagtcgcaaaagacaacatattgtataattccatttatatacaatgctcagaatcagcaaatctatagacagaaagtagatgagtggctgcctagggaggccagggtgggatgattgggtgtgatagctaatggctgtaaggtttcttctagaggtgatgacaatatataaaaatgtattgtggtggtagatgcacaactctgaatacactaaggaccatcaaaccgtacacttgcagtgggtgtgttttatggtatttgaactatatctcaacaaagctgttttaaaaacagattataccagtactggaaaacaattttctcaacagaaatcaaacatttgtaaattcatggtcatcagattttcatttacattttaattactaaatataaatcctaaatctaaatatatatccaaacataaacttgtttttctcatttttatgattatttagcttattaattgttcaattttaatttatccctctactgattgctgaaaatcactaaatttttttgaagaataattttagatagatttttaaggtcaataaataccttggaaaaagacactttctttattttgaaatgtaatctttcactgtttcagagtaaatacacatcaagaatgactcacatgtaaataattgcagataaaatccgggaactacatttgagcagagccagactgtcatcctgtagttcttcaaaggctttggaactgccgccagtggttacatattttgccgctctaagtatcttaaaatggaagaatccccctcatactttccataaagattcgcccaccacaaagcatatttgtttggagacctcctcagtgacatttcacaattgtgagcgtgaattatagattcctattacttaagcttttcatcaggcctaactctatgaattttgctagactttttatttttcactgaattctatttcaacctcatatccattgtggataacaggaatttttctctccttccggaaatccttgttttgtgtgtgtgcatttcagaacacatttgtgtgtgtgtatttctcttgaatcaacaaccagtgactgatctctgcagatctactgataaaggacatttattttacatttgtactttataatgtcatgtgataaaagttaagccaaaattctgggtgacaagtcgcctaaggtgtcttaagagctgagaacaagttatgttcagaatgcatggatttctagaatggatatcccaaacagctactatatacattattatggagctgctttctgtttcttgagaacttgcattttcagaaagcaatgtccctaaattaaaaatggcatttgaacctagactcctacataaatctgtagtgggtattacatatgctttggggtctggaattctaaatctagctcccgttctggcatcttcaattagtgccacttggaaaagatggctttagttcttctcacctcagtctcctaacatataaaatgtgtacaatttttacctacttgatagaactgttgagaaaactaactgaggcagcacatgtaaattacttcacacagtgacaaaaacactaaagtttttaatagtagaatttaggttgcacaatgtcttaaatatagaagctagatagtcaatatacattagttttaaaattctgcttccttaactttctaaaactatggagtgtagattatttgtataaatccatgtatatatggcaccacattaatgaactgtatagattaactatcttatattatcctgcttggtttgtgatgaagaggacagcttgctccatctttcagtgtaattttaagacagaaagcctgttataaaaccagtgaatttccaggccatcataataaaatttcctatgataataataatgtgcttttgttcaaaattaaaatatttgaagagatgagagttttaatattagtttcaaagactgacatgacttattaaaattatattaatttacgctcattatatcttttatgataaaaattttaaacctctgaagcaactctgagttcattctagcaataaaataaatatttcaacacctactatgtgccaggaagtttttaagtgcttagactgtatcagggaacaaaacaaagatcttgctttggggaagtttacttttctgaggagggagaccgacaataaactatacacacaaaaataagtcagctgtttagtatgtacaacagataaggagaattaagagttccattgtggtgccattttaaataagatggttagtgtatgtctggttgagaaggattttaagtgaaaccacttaaaagaggtgaggaaattagcagtgctgataattcagaagagtaaccagcagaaggagggccagggcaaaaaggccccagagcttgagtgttcctggcacgtttgaggaacagtaaagggccattgagttggaagaacagttagaaatgtgctcaaaaggtaacagaggagcttcatcaggtggaaacttgtagtccattgtaagtttggggaattttcgtctaagtgaaattagaagagttctgagcagagtggcatgctctgaccgatactcagaaggagcgctccagctcatatgttaagaatagacagcacaggaagaggcacagaaacagggagccgctcagcagggcatcgaggtagaggaaagagaagatggcggctgcagagaggcagaaaggaagccggaagcagtagggatctcgatttcggtatattctgaaagtgaagtcagaatgatttcctgacatagtggagctgggatattaaagaatgagggaaatcaaacgggattccgatgcttttcacctgaacgggaagacagacggagtttcaccaaccaagataggggaagctgtaagcagatcgtttgagggaggtggaaatcgggagttcagtttttggaaacatttagtttgacatgtgtatttgtcacccaaatggagctatcaaggggacagctggatacttaagaccacagttcaggacagtggtcttggctggagattatcaaaggaatgaaagcacgcagagtagacgatcaaggaccgaactcaggttattcaaacattaagaaagagacaaaggagtgacgttggagaaaaaccaaagataatgtaatattctagcagccaagtgtggaaaaaaatgtttagggagaaaggggtatacaactacatcaaatatttctggtaagtcaagaaatatgagagctgatcattgactattggttttagcaatctcgaggttattggtgatctctgacaaagcaattttagaggaatggatgaactgaaagccagatttgaatgccttaagagaataaggaaaggagaatctgagactatgaaaaaagacaatctttagaagagttttactacaagggataataagaaagtgggaattaagaattttaaagattcatgaaataacagtagtaaaggcaataattcagtagagaagggaaggctgatgatgtatgacagagagacaattatctcagaatagacaaagagtaggctgtcctgcataaatagaggggctgcacttacataggatcataaataatttgtggtttcaggcagaaagacagttggtgggtagatggcatgataggattctgcagaactttcttttggtttcctgctttctcaatgaagtaaggagcaagatcatcagatgaaagtgaagatgagggaggaagtattggagatggaggagggaagaagagaagatatgcaactgtcatcaagatgctcggatagattagcaaacataacagggttgctgggaacatcaaggacccacttaataattttggtcataaactgaacatgtgaatttaaagctggaccagtcattgtttttacccaactatgttcagttacatggatgcaagtatggaataagcaggagttggaattaaggttgtgttttcattttaagtactaaaaactgagttgatttgtttcccatagttgtaacaaattgtcacaaatgtggtgacttaaaacaacaggaatttattctctcactgttctggaggccagaagtcaaaatcagtatcaagggctatagacgggttgacagagctgcactccctctaaggctccagaggaaaatcgtttctttcctcttccagcttctggtggctgccgcatttcttggcttgtggctgcatcacaatgagctctgccctcgtggtcacagggccttctcttccatgtgccaactttccctctgcttctctcttagaaggatacatatgactgcacttaaagcccacaccaaaaatccagaataatctctccatctcaagattcttaatttaatcacatttccaaaattcttttttttgccatataaagttacctttgcaggtccagggatcaggacatgaatatctttagtaggggccttacctagcacagcacactgaaaaaaggaaagggagtgagcacatattcaaagtgaggttactatcattggccatgaaatttaagctttgataagttgttttcatagattaagtgagctaaacagaggaggtagtggtcaggaaatgttgacttataaaaccaaaatcatagtgggccagtacatgtcggtaatgacaaggtctagttcatgtctgagatcggatggaagacaaaattatcggaaaagaagaagtcaaattgagaaagcaaacagttggaaataccaccttcaggtagattaaaattgtcaaaaattaagagaaatggatacagagaataaatagaattagtaggtagaaggataaatgaaaatgtgatagatttaaattcatactgttcactctttatatgatatgtatctgtgtgtgaaaaattccaatgtaaatccttctctttccccaggtaactaaattatgccacttgaagttaaaaaattatcaaaattcaattttcattgagagggtttttctaatatatttttatgcctgtgttcttaggtaaatgtagcctgagatatagacatgagtttatcccttgagttggagtgtgtgatgatgctccaggggtcttttgaggtgtctgaaaatgtttacttttactttcgctctagacagctgtgtgttttaaatcttgggtctgctatttatattttctattacctttcttgctgcttagctgtcatctgtcacttacttttgttgtcagtgtgcttttaggcttttgcattccaatttgtagtttataagatgtcttagagagggcaaacagggagaaaagctaattataattgtgttctaaaaatgagaaatgtgactctgaatgagatcctttgcttctaaattaagtttatggactacaaagtctacgaacagatagtctatgttgtatggctatttctcatttttacttgtattacggatgtctgcaaatttgctattaggtgtctattcagataccgtacttatgaacactaataaatctccataaaaattaaaagattgtatatcaaagtttatggacaatatacaaaaatctcattatctccagataatgtgttgttattactgtatttccaaacccatagactctgttccatatccattttctaaaatatgtcggggtcctgtctggaaacagatgactcactcaaatttagcatttttaggagagttttatagatgactatttacaaaactgaaaacaggatttagaaaaaccaaaatgggaggtacaatattccagagctagtaacaggaagctgtttgcaggactaagctgacaggagtttttatcaaaatctggagagatccttgtgttaggagctgctggagaggagctgtggcctcccctggactgataagtcagctggaggatacctggcagggagaaagccagagggataaagaaccgacttccctcttcagccaccgtgacttcctagcgatgcctccctggcccacgctgaacaggaaatcagagctgaagtgagcccactgatttagtttgtgttacctggactttccggggcagaaagcagatacagttgggtgaaaggtgaagggtggctacggaagggcaaatggaagccatccaccatggtacagaaatgaaatttgaacctgaacctccctcagcaaaagaacaacatataaaaaattacatgtagtaattgaaccaatattgttttccatcaatagtattataaatacatgctaatatatttatgatgacatgtcatcccttttggaggttcctgcagataaattatctctaaaacttaggagcagtctcagaaagaagattataacaaatgtcatttcctcattcaaggcaaaaagttagtattattcttttaccatctataaagtcttaaaaaataccagatttagactgacttttctcaagatcaaataatttacttgatgagtcattcttcataggaaatgtatgaagagtttgtaagtatataggcccaaatgagataagggttccctgaggcagcacatgtggtctgtgtttgttggatgctggcaaatgactttgtctcagtccttctagagggaagcacacagttcacttccatcagaaagttagtctgtggagtattatactttcccgtatagcagattcagattcaagttaattttaaaatagaaaaagtctacattctgctctcgacaatatgtttttcctattcatagtttacaggccagatgttattttctgaagtgcaagtaatgaatgcaagaattttaggaacttcatgagagtatttcagagtgaggaatattaatacttagacaataaaagagaataacaaattcgtattaaagtcattaaagaaggtcacatgaaaaaatgttcaaattccagaagtattcagtctaccagcaatcatttgtatttattttctcaatgttatttattttctaaatatttgagagcacagtcaccctgctataatctaactatgggtggttttttttttagaaaaaattttgttgttataatcagagggaaggttctgcattctagtcaactcaatgagagataacacttcagaatgcatgacagaaagacctagagagaatactgcaactgcaggctagaaaaaaagagataaacaaaatctcattatctccagataatgtgctgttattattatatttccaaacccatagactctgttccatatcaattttctaaaattgggcaattttggtaagttttctttttataacattaagtaaaaatagaagcattaatgctaagtgaacctaaatagatgctaatatcccttttagtggttcaactttgcagttcaagaaagacgcctcatattccatctgtggttaggcattgtgttgggcacatcagagtataaaaataaatgcagcaaaattaaccatctgaacatacaacaacttcttaatgcatctactgtgccagacactgtgttaagtgttagaagtattgagaaagaaaaatgcagtcatgtcctaggggaacttcaaccaaataagagggaaacaggcaaactgatcacatagagtgacaactgaaagtgggatttgcactcagtgttttgagagtataaaaaagaagccctcaattttgtctgtgagatggtagatcaaagtagcttattaagaggaggacaacataagtattgaagaatgacttaagcagagggaggggattattcagggtagagggttataaaatgttcagggaaccatagatgattttatatgataaaacgaaccctgaagttgaacagtaattcatcatgattcttagacacagtcagaagttgtcaaataactgaatatgcccttcagcaaggtttctgattttgaaaaaggaaaatatgccttaatttttcttgaacaaagacatcaacaacaattaattggaaaatctttgcctgtaggaggaacgggacacttccccaaattgttttacattctgtttagattggaaatgctgtaagagagaattgttaaaaacatacaaaaactaaacaagttaatattgagtgcagttgaatagaaatattattcaaatatgaacctacatggagttgatgtggggctaaatatacagatttatatatgtttctataatatttaaaataaagttacttttttttttttgagacaggagctcactctgtcacccaggctgcagtgcagtggcacaatcttggctcactgcaacctctgcctcctgggttcaagcgattcttccacctcaacctcccgagcatctgggagtacaggcgcccaccaccatgcctggctaatttctgtatttttagtagagacaggatttcaccatgttagccaggctggtctcgaactcccggcctcaagtgatccacctacctcggcctcccaaaatgctgggattacaggcatgagccaccatgcccagccaatgttgcttttgaattaaagattttattattattgaggctagttgaaagcaaatggcctagctatataaattatcattgcacaggaaagtctcatgtagtaccatgtattgtgtgaatatatttactgtttatatatatacataaatatctacacacatacctttatgtacatatgtatatataaccagtaaatacacatattatcatatttatcattgcacagaaaagtctcatgtagtaccatgcattgtgtgaatatacatttatatttatttactgtttgtatatatacatatctatacacatagattatgtacatattatatatacgcagtaaatatatatgttcacttgtatattttaaaaataaaacaatggtcatctaacaagagacctgcatcaggatatacagaaggatggaaacttcacttgtctgattgcatcttgctttatactgtatttcaaatccatgtaagtattttacataatagaagatcatatccaaaaaacagaatccacaaaattaaaaactatcaagttgtgctttgtgctaccgtcatgtgccaatgactctgaagagtgcaggtggtaaacggctcctccctgctaggaagaccctgcccccgcagcgtgttgctagttagagctactgaatcaattcttacctgaaggcagatcgcccccaggacattttagttgcacaagtcattggagtctcttttctgtataagtaattttgagctgaatttctgtcacttcccactaaaataactttcagtgattcactgaataatagtggagtctacgtggagctgacaataattggaaaaaatagaatcaattaagagggaaagaataggaagaagggatacattcaatcacaggagagtcaggacaaatacgcgggtgaaagacatgacagtttttaaccaaaagcatgtcttgagaaggaattggattagaattgttttaaaaagctacatgattgtcaaatttttaaaagcagcctaatgcatagattgcaacatacaacgtgatatttaaccatgctttggatgattaatgttaacaatagtgatggattgaaactgttgcatagtgctggaatttaagtggtagggataaatttctctttatttttgtatgtagatgcatatgtgtatacacacacacacacacacacacacacacacacacacacacacgtcttggaactcatcaaataaagcagatcttttccaagtaagtccagtaaatgcagggctatgcactcaaagtgaaaaaaattacagaattttaataaaaatcaaagtcatcgtaccatcgtaattctctccccatttcgctgcttctccaaccctgtcttacatacagatgccttaaaaactgcagtgaatcttttttcttgaaaaatgtctttatgccatataatcatggcttccactcaatcttttggcactatccaatattaatatgtttttggaaataaacagaagaaacagtaatggaagaggtactcaatagaaaagtctcttgaggtctaatttgggtggcactggggaaaatgcccagaaggtctgcaaacaagtaatgggcaatctagacagtgttgagaataatacagcagattttaaaaaggaatagcacgtataaaaagacttttccatttagggtgccaaaatcctaaagtaaggacttcaaaaaataatggaaagaaacctctacattgaggctatagcagattttgtttgataagagaagatttagtacatggaagttgtgtttgtcttctgaatagtaaaaatatctcactaaggatatgcaatatctttctactttcatgtgatcattttaaaagggcaggaatatgaattcaactgacaaaagattacttcagtgtttctggtttattttaatgtgcattttttcagtaaaaccttacagtaataaagattttgctgtcatctcatgaacaaataagtgtattactttacaggcaagaaaggcaaactagaataatgaccatagcatcatttatgggtatatagaaattatgtcctttttataaaggagatcttaataagcggtttgggaaattatattacaagccattctgtattgatttattatcttctaatgctcatttctgccatgcactcaaagctccaaagcattaaaattggtatccactgtagtttgatgccagttctgaagttcaaatggcaaataaattctcatattaatggtaatggtgtgaaactgagaatttattgaagttatttgttaaacttcagtaggtacctatagctagttttcatgtgaaaaaacctttagtaagagagcaactttgaaattaactcatgaaattagttaaattttggctttcctgccactctggcagttttgttaactcatgggagtctgttcagggtaataacacatagagaagtatggaccctaataccagtataaggcagaatgaagctgttctctaccacgagaagcaaacaagaacctatcagagccatcagacaatcatgattccagtgggccattgggaaagaatatatgcaggtgttccaggcagatttagctcataggaacagttacaatattttatacacattttacaaaggatattcctaaggatttttttgcactcatttccagatggtgacttctttaaaagtagaaacagtctgacatccacccagaattaagaccaagagagtactgtattaaactaatttaaacgtcaaagcatgttgcttttaatgctgtgaattcacccagactcaccttctcagagccttctttgttgaaagaacataatgaataacctttaagtgttgcttcctgcgagtcagtgccagaacgttctaactggtagaccaagaagcctgtcagcatttccatcataaacctatattatctggagctcataagttggctgtaaaactcaggcagaatctaggcattgaaacctttctggaaaagtgttatatttttaggctgtgtagactacagggtggtaaaaacacaggattttcaggcccaaatatagcagtactttacacaaatttaaacacattaaagtaaaacagaaatgtcctatttctaaattcacaggacacaaaaagaacacataattttaggccactatccaaaccttgtagcctgattttgtccaaagtctgtcttccattatgattatacagaaagtgttgaaggcattggtaagttttcagaaaccgatgaacaaacctaaaaacttgatgttttataaactattcgtctttgaagtgttgcatatgttctaaagtggtcatgtgaaatagctaaagctctttgttattatacccttaaaagtattttttgtagagtactttgcattgtataaaataatttaacatgcagtatttaatttaactctaaaaaaagaatcctgtaatattaccctcattgcacagaaggtaagcttagcacataaaagtattactcagtcatgcacagaagttaagttcaacccaggtcttccgatttcaagttcagtctggtaccactgaaaacacccctatcatgtcaaccctcctaatttctcattcatactgaatctgccgctcactatcattatggcctctcctgctgcgactgctctctgctcccacatcactcaaccttcttcctctttccacagcttcacaggttgacctcttttaaacatacctgtggatgtctcgtaagctcagcgcaactcacctggggcagttttgctttccaggggacatttggcaatgtctggagacatttttggttgtcacaacttcatgtgggagggtagggtactgttggccaatgtccagtggtagagaccagggatgctgctgaacagcctacaacacccagcacagccctgcccaacaaataattatccagtccaaaataacaacagtgcagaggttgagaaaccctgctccggccagaactctagattaacaatttaggattattaacctgcttaattcactcttgaaccccaggtgacacatcttcgactttctttggtttctaaacaatggtatgaaatgtcaaatgctactttgtcgttctagaacttagatctaagctcacagaaaagcaagaatgtgagctctatgaggatttgggatctgctttcttctttcgtttctattgtttagtggctgcctcatagtgggtgctcaagaaggatcagctgaagcaatggcaagtataggcatacgtcttcactggattatagaaatatgtgctgtccatggacatggggaggggaacatcacacactggggcctgtagggggtgggaggctagaggagggagagcattaggagaaatacctaatgtagatgatgggttgatggatgcagcaaaccaccatggcacgtgtatacctgtgtaacaaacctgcacgttctgcacatgtatcccagaacttaaagtataataaattaattaaaataaagaattaagtgctgtctgtgactgaccccttgggcattgccattagtggctcctctaaatcattccctgtcctgaggtcccctccccttcctcctcattcctcctgcgtcttctaggccttcctgaaaacaaggccctatcatttccattattacactctgttagctccatcttcatcactttcaaatacgctgaaaaatcctccttctagaataactctgctaccaacttttctttctgtatttcttttactgctaaacctcttgagtcgtgattggctccaattccttagcatatacagtgagtaaccttttgcaatctgagtggatttcccagcatgctacaaatactgttcatctgaaattcaatcttgattttctgcttacaaaccaagaaaaggcctttgttcttggaagtgcccttgaccttgctagagcctgcaacaattgtgatctccttcatgaaattccttcccatactttctaagagactgcatatttctatcttttcacttttatacttaaaccccagtttttatttttcttagtggcaacttttcatcttctatcctccttaactggatgttttctaagctttgttgttctctgaggttatttttctctttctaagttttctcccttggtccctgcattgacttctctgtgaataactagaaaatctttgctcccaagcattcatcccacatttcaaatcaccagtataacatggctgctgtaacttcaaagtcaacacacttaaacaaaaacaactatttcttccccatccttttttataacttacctcctcatgctctgtggcccccagacacaggaaggttctatttaggggcagaactgacataaaaagccttctttccctgagcctgctccatacttaagccatctctgccattttgccaagttattgacctaagatcctgaaattgatctctcctagctacacgcaactctgtagaattagcaattccactggccattcctgtaagtccacccttcaaagtgacaccacgtgctaaagaaaacaactcttgagaactgtttcataatggtaattggcaacactcacgtggacatgcttatccatactaacttattaataccaccattctatggggtaggttctactcccatacacagttgttacagataaggatccaaggcagcatggcttaagtaactcatttaatgttacactgctaatgaggtagccaggatttgaacaaagctgtgtggctccggtgtccatgcttttattcactatgctctatctcttccttactgcagggcacatatgaaaatggtgattgggtggacattttcacatatgaaaatgaaagtgtgattgggtggacagtgtagaacaaagagccatgcaattttaaaggtgagttcagagggttgaatagcacccctcaaaatgatatgcccaagttctagcctccagaatctgtgaagatgacattatttggaacaaggatcttttccgatgtggttagcttaaggatctccagatgacctcatcctggatttagagtgagcccaaagtccaattattggggtccaaataagaagagaggaggaagctgacaaagaaaaggtgacgtgaagttggtgttagagactggagtgatgtgtcaatcagccaatgcataccgaggattgctgacaatgccgacacctgggagagacgcagcaacaggttctccctcacaaatttcagaggcaatcaactctgctgacccctggaatttagactttgggcctgctgcatagtgaaatgataaagctccattgattatggtgccaacttcgtgtggacttgttagtgcacctctgggaaacaaatgcaatgggagagatcactgtgagctggagcagggagtccaataatggagccctcaggcaagtggcaaatctctaatgaaatgcatctcacaaacagaatgctgccaaagactaaattttcttttagtttttctaacattatttttgttattatactttcagttctgggatacatgtgcagaatgtgcgggtttcttacataggtatacacgtgccatggtggtttgctgcatccatcaacccatcatctatattaggtatttttgctatccctcccctagaccctcaccccatgacaggtcccagtgtgtgatgttcccctccctgtgtccatgtgttctcattgttcaacactcacttatgagtgagaacatgcagtgtttgattttctgttcctgtgttagtttgctgagagtgatggtttccagctacatccatgtccctgcaaaggacatgaactcatccttctttatggctgcatagtattccatggtgtatatgtgccacattttctttatccattgtaccactgatggccatgtgggttggttccaagtctttgctattgtgaacagtgctgcaataaacacacatgtgcatgtaactttatagtagaatgatttataatcctttgggtatatacccagtaatgggaatcctcggtcaaatggtatttttggttctagatcctgcaggaatcaccacactgtcttccacaatggttgaactaatttacattcccaccaacagtgtaaaattgttcctatttttccgcatcatatccagcatctgttgtttcctgacattttaatgatcaccattctaactggcgtgagatggtatctcattgtagttttgatttgcatttctctaatgaccactgatgatgagcttttttttcatatgtttgttggctgcataaatgtcttcttttgagaagtgtctgttcatatccttcacccactttttgatggggttgtttttttcttgtaactttaagttctttctagattctggatattagccctttgtcagattgatagattgcaaaaattttctcccattctctaggttgcctgttcactttgatgatagtttcttttgctgtgcagatgctcttcagtttaattagatcccctttgtcaattttggcttttgttgccattgcttttggtgttttagtcatgaagtctttgcccatgcttatgtcctgaatggtattgcctaggtttttttctagggtgtttatggttttaggtcttacatttaagtttttaatccatcttgagttaatttttgtataaggtgtaaggaaggggtccagtttcagttttctgcatatggctagccagttttcccaacaccatttattaaatagggaatcatttccccatttcttgtttttgccaggtttgctggagatcagatggttgtagatgtgtggccttatttctgaggcctctgttgtgttccttgggtctatatatctgttttggtaccacactatgatgttttggttactgtagacttgtagtatagtttgaagtcaggtagcatgatgcctccagctttcttcaatttgcttaggattgtcttggctatacgggctctttttttagttccatatgaaatttaaagtagttttttctaattctgtgaagaaagtcaatgttagcttgctggggatatcattgaatctataaattaccttgggcagtacggccattttcaagatattcattcttcctatccatgagcatggaaggtttttccatttgtttgtgtcctctcttatttccttgagcagtggtttgtagttctccttgaagaggtccttcatatcccttgtaagggatatgcactgtgtctgagagattgttgtgatttacaattgtttgcgtttgcttaggagtgttctacttccaattatgtggctaattttagaataaatgtgatgtggagctgagaagaatgtatattctgttgatttggggcggacagttctgtggatgtctattagttccgcttggtccagaggtgagttcaagtcctgagtatgcttgttaattttctgtctcatttatctgtctaatattgacagtattcctagttattttattctctttgtagcaattgtgaatgggaattcactcatgatttggctctctgtttattactggtgtataggaatgcttgtgattttagcacattgattttgtatcctaagaccttgctgaagttgcttattagcttaaggagattttgggctgagacgatggggttttctaaatgtacaatcatgtcatctgcaaacagaaaatttgactttctctctttctacttgattcccctttatttctttatcttgcctgattaccctggccagaacttccaattctatgttgaataggagtggtgagagagggcatccttgtttataccagttttcaaagtgaatgattccagcttttgccattcagtataatattggctgtgggtttgtcataaatggctcttattattttgagatacattccattaatacctagtttattgagaatttttaccatgaaggggtgttgaatttcatgaagggcgttttctgcatctattgagataatcatgtggttgttgtcattggttctgtttatgtgatggattacgtttattgatttgcatatgttgaaccagtcttgcatcccagggatgaagcctacttgatcgtggtggataagctttttgatgtactgctggattcggtttgccagtattttattgaggattttcacatcaatattcatcagggatattggcctgaaattttcttttttgtgtgtgtgtctctgccaggttgtggtatcaagatgatgatggcttcataaaatgagttagggaggagtccctctttttcttttgtttggaatagtttcagaaggaatggtaccagctcctttttgtaccactggtagacttcgactgtgaatccatctggtcctggactttttttggttggtaggctattaattactgtctaaattcagaacttattattggtctattcagggattcgacttcttcctagtttagtcttgggagtttttatgggtccaggaacttatccatttcttttagattttctagtttatttgcatagaggtgtttatagtattccctggcagcagctttgtatttctgtgggatcagtggtgatatcccctttatcatttcttattgtgtctatttgattcttctctcttttcttctttattaatctggatagcagtctatctattttgttaatcttttcaaaaaaccaactcctggattcattgattttttcaagggttgttcatgtctatctccttcagttctgctctgatcttagttatttcttatcttctgctagcttttgaatttgtttgctcttacttctctagtttttttcattgtgaagttacggtgtggattttagatctttcctgctttctcctgtgggcatttagtgctatacatttccctctaaacgctgctttagctgtgtcccagagattctggtacattgtgtctttattctcattgatttcaaagaaggtatttatttctaccttaattttactaaggttgaaatttaagttatttacccagcagtctttcaggagcagtttgttcagtatccatgtacttgtgtggttttgagtgggtttcttaatcctgagttccaatttgattgcactgtgtctgagagattgtttgttgtgatttacgattgtttgcatttgcttaggagtgttttacttccaatcgtgtggccaattttagaataagtgtgatgtgtagctgagaagaatgtatattctgttgatttggggtggacagttctgtagatgtctattagttccgcttggtccagaggtgagttcaagtcctgagtatccttgttaattttctgtctcatttatctgtctaacattgacagtggggtgttgaaaatctcccactattattgtgtgggagtctaagtctcttcgtaggtctctaagaacttgctttatgaatctgggtgctcctgtattgggtgcatatatatttaggataattagcccttcttgttgcattgatccctttaccattatgtaatgcccttccttgtcttttttgatctttgttggtttaaagtctgttttatcagagactaggattgcaactcctcctctttttttgctttccatttgcttggtaaatatttctccatccctttattttgagcttatgtttgtccttgcatgtgagatgggtctcctgaatacagcacaccaatgggtctacaccaatgggtcttgactctttatccaatttgccagcctgtgtcttttagttggggcatttagcccatttatatttaaggttaatattgttatgtgtgaatttgatcctgtcattatgatgctagctggttattttgcccattagtttgtggagtttcttcatagtgtcaatggtctatacaatttggtatgtttttgccatggctggtactggtttttcctttccatatttagtgcttctttcaggagctcttgtaaggcaggcctggtggtgacaaaatatttcagcatttgctgtctgtaaaggattccatttctccttcacgtatgaagcttagtttggttggatatgaaattctgggttgaaaattcttttctttaataatgttgaatattggcccccactctcttctggcttgtagggtttctgcagtgagctctgctgtaagtctgatgggcttccctttgtgggtaacccgacctttctctctggctgcccttaacattttttccttcatttcaaccttggtgaatctgacaattatgtgtcttggggttgctcttctcaaggagtatctttgtggtgttctctgtatgtcctgaatttgaatgttggcctgccttgctaggttggggatgttctcctggataataccctgaagagtattttccaacttggttccattctccccatcactttcaggtacaaacataggtttggtcttttcacatagtcccatatttctcggaggctttgttcatttcttgtcattcttttttctctaatgttgccttcacacattatttcattaagttgatcttcaatctctgatatcctttcttctgcttgatcaattcagctattgatacttgtgtatgcttcacaaagctcttgtgctgtgtttctcagctccatcaggtcatttatgttcttctctaaactggtttttctagttagcaatttgtctaaactttttccatgttcttagcttccttgccttgggttagaacacgctcctttagctcagaggagtttgttatcatgcatcttctgaagcctacatctgtcaatttgtcaaagtcattctccattcagttttgtggccttgctggcgaggagctatgatcttttggaggagaagaggtgttctggtttttggaattttcagcctttttgctctggtttttccttatcttcacggatttatctgcctttggtctttgatgttggtgacatacagttggggtttctgtgtggacgcccttttcgttgatgttgatgctattcctttctgtttgttagttttccttctaacagtcaggccatctgctgcaggtcagctggaatgtgctggaggtccactccagaccctgtttgcctgggtgtcaccactggcggctgcagaatagcaaagatcgctgcctgttccttcctctggaagcttcgtcccagaggggcacctgccagatgccagctggagctctactatataaggtgtctgtcgatccctgctggggggtgtctcccagttaggaggcacgggggtcagggacccacttgaggaggcagtgagtcccttagcagagctcaagagctgtgctgggagatccactgctctcttcagaggcagcaggcaggaacatttaagtttggtgaagctgcgcccacagccgtcccttcccccaggtgctgtatctcagggagatgggagttttatctataagcccctgaatcgtgctgctgcttttctttcagagatgccccgcccagagagaaggaatctagagaggcagtctggctacagcagctttgctgagctgcggtgggctctgcccagtctgaacttcctggtggctttgatttcactgtgaagggaaaaccaactactcaagcctcagtaatggtggacaccccgccccccaccaagctcgagcgtcccagatcgacttcagactgctgtgttggcagcgagaatttcaagccagtggattttggcttgctggcctccatgggggtgggatccgctgagctagaccacttggctccctggcttcagctacctttttaggggagcgaacggttctgtctcactggtgttccaggtgccactggggtatgaagaaaaactcctgcagccagctgggtgtctgcccaaacggctgcccagttttgtgcttgaaacccagggccctggtggtgtaggcaccccagggaatatcctggtctgccggttgcaaagaccgtgggaaaagcgtagtatctgggccgaatgcaccgtccctcagggcacagtccctcatggcttcccttggctggcggagggacttctctgaccccttgcgcttcctggatgaggcaacaccccaccctgctttggcttgccctccatgtgctgcacgcactgtctaaccagtctcagtgagatgagccaggtacctcagttggaaatgcagaaatcacccaccttctgcattgatctcgctgggaactgcagactgaagcggttcctatttggccaccttgccagcccatctcgagtaagttttcttatctttgcatgtatatccgataagctagatttagtggtcaatagcgatttttggaatgaatgaataaataataaggattgctcttttttttactgcactataaatgtgtagaagtcatgtaatttaaaatttatttgtgttaaaatgttgggtaaaatatttttactctactttaaatatctaagttattaaatataactggctgcatttattttattaaaacttacaaaataatttttataactatacaaattataggatcatctacatattgtgcctattaaaattttacttaaatatgattttagttttttatagacagaagtataaagaatgcttcaaaatcttaatcatttagaactaaaattatgtctggtgtcttgaaatccagatttacgtatgtgttaaagatactggttatttcctcaagtcaaatcatggaattgagaggtagagttgaatacagttttaataaatatgcattggttcctatgtggctattcttgctgtagtagtacactaacactctacaaaaatctgttttacaaaaagaaacctttggaagtaacacttatataaattaatgaaaaaaatgaatgaatatatgtaatgtaataaacattaaatgattaatcagtggagatcctggattataagacaataaaaatattaaacagttttctcagggaaaacattttaggacaactatatatatatatatatatatatatatatatatatatatatatatatatttatttatttcccccctattatttcaggggctatatcgtaaagaagaaataaaacttgaaaataaatgtacattgactaagaatttaactgttgaaactcaaacacctatatctttcatatatatgtacatatgtgaaatatatagctctgatagatatatgcacacacacatacacacatacatatatagtggctaaagatatctttatttcagatatatattttttcatatatctttcataaatattattgacatacatatttcatatatgtatgtacctatattcacatacacatagccctgattttatcttagcacatacatttattattatcttactttggaaatattggaaataaagtattaggtgttttttagcacatgtagagctcagctaaaagcaaaagcaatggaaacattttcaaggacaaatttactaagtatcgtagcaatgccacttatttccatgtaacaaaaagtattatttatacatttactatttgggttaattaaattttttgccctgatgaagacctgaagcaatttcaggatagaatttttagaatgaagaggaaccacgaaaagttgatatgcataaacagagaagcttgctaattctagacactttcatatttagatattggttgtatctgtgtctatgtacaagatacccaatctttcttttttttattctttttttgagacagagtctccctctgttgcccagtctggagtgcagtggctcaatctctgctcactgcaacctctgccccccaggttcaagtgaatctcctgcctcagcctcctgggtagctgggattacaagcatgtgccaccatgcctggctattttttgtatttttagcagagacagggtttcagcatgttggtcaggctggtctccaactcctgacctcgtgatcctcccacctcagcctcccaaagtgatgggattagaggcgtgagccaccatgcctggccgatacccaacctttcaaagcctggatttccatacacaaaatatacctaaagatgcctactgtatttggtggggaagtcaatgtgaaaattagtgtaaatgctacacagtagatagaggttgatggcctcttggtcttttcataatcattatcacaggaaacacaatgcttacattgctttacctaattctacttgttccatacaagaaaattagagctggtcactggattaaattgtatttgttaccttcctattctaagtatccttaaaataataggaaggtaacaaacataatttaatagatatatagataacatctataagacatatctttaatagacatgtagataacaactcaaagagatctggcagcttctcttctaagtaattaacctgcacacatatggtttacctagacaatataacattttttgagtatggggagatttgaagcacaagacttgatgggtatgagcttataagtattattattctattgaatattgttttttggtttgaagtaaaatgttaattgaattggtaatggttttggtaataaaaagatgcttctgcaagaacataatgaaatttgattgattcactaagcttggtcttaagtactcgcatcaatgcttttagcttttaaaataaattgtatcaattattgcttaaatttaacattgatgaaaaacatttctagcccctggttaccattaatgtctatatagttaacaaagacatggggagttagctgcaccattatgtgaaggctctttaaattaggtttactgtaataaacacacacaagttatttctacagctctgaaaatcggaaaaggaaatagaagatgtttagggtcactgtcagttctgtctaagcctagattccttttctgtaaaatgaggatgataataatgatatgcccctttgtgttttttagaataacagaataaatgatcaataaattttagcaatgattattattatgcacacacaggcactgtgctatcctctataaaactgtaggatggatgagatgtaataattatccttgtataagtttcctattgctgctgaaacagattaccacaaatgtaggctaggcttagaacactaatttattatcttacaggtttgtatctcaaaagtctgttgctggtctcacgaggctaacgtcaaggtctatatgctggagctcctttcaggagcctcgccaagagaatctgtttccttgctcattgaggttgttggcagaattaatttatctgcagtggcaggatttagattcctgtgttcttgctggctgtaaactctgggtcattattaacttcctgaggctgccacattgctggctttctgacttcttcctctatcttcaaaatcagcaatgatggatggagtctctcccatgtcaaatctccctgacccaccagtcaaagttcttagctgttaagaattcatgtgattacagtggacccacctgtgataatccaggatcctctccccatcggaaaggtggtaccatctgcaaagggccatctgcaaagtcccttttactgtgtgacataacacattcacggatcccaggaactggggcataacctctttgggagaagcattatcccgcctaccacaaaccccaagcttttatatatctgggaaagtaaataaaacaagtatataaataacagccacataaggccgaatgtgcatcttgctttaagaaactataaattcattgttcaatatctaattagaagggagtaatataactcttccttttatcatatatcattataaagcttttatactaggatcttcccctgtataagggattgttttctcttatcttggtctcctcgttcctcatcgattgttgttcctgcagcaattaccgagcagcgaaaatgcagtggaatggccactttacaggagggaagccgtttccaatactcacgaagtacaactcctaacctggtgggcttgggcatcctgggtatttgttcagataatcaactttaaggcttttaaaaacatgttattttgtgaaatatttgtatagaaatgctcctgttccttctttatttacccttaagagattatgatcagaggttagttatgtgacattggttctctcctctgtggctgaattcttgagaacattgccaatattagcagaccgtattgtatttctcatatcttatttttttccttttcatatctgtcattatcatctgatgcccttcatcataacctaattctattcttcaactcaatcactgcagaatggtgtttttttccttgacctttatctagctgtacagagtttttcattctttaagtataaaaatatttcctcccactacttgagtattctacttctagaccttcccaatttaagcacctatatgtatcttcatctcttcctttctgatggagtttcacagaaaaaaaaatagtaaaaaattctgacctagatcagactggttaatagctagctggtttcatatgagcaaaacgacagcttgtaaagtgctaagcttgtgtcctaaaaaagacatgaagcgcttcctttagcataacataagataaagccaaggtaaaatagaacattgtagaataggatttaatgaattaataaaaaagaaagagtaagtcatacagacagaggacataaggaatggtgtgtgagtacatgggcttgggaatcagacgacctgagcttggacaccagctctaccacctgctacttgttgagcctggacaggtaacttactgcaaagcacagatttccttataggataaaaggctataaaaatatccatcttggatagtagtcatgaagagatgatatacataaaaacttggcatatgctaattgctcaataactgagagtttaatatttcctcagacatcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcagtaagtcttgtgttttaaatcatgttatcagcctacatgcattatctcttttagtcatcatcataactctgtaatataaatactgtaaaatattttatagaggagaaaaaactcctatgtagtaagaagagagataacttgtcctagtacacactgctagttggaaataaaccaaacaaatgaacccaagttttgcccccagaacctatatgttcatatttcaaactaaacaaccatctttcctggaaagcaatctcttctccagacatctctatttctctcaatagaatgaacttcttagtgatttattttttaaagttaaatgtcataaaataggcatatgttgtagatataaccaaattgaagtagcatgtttatgtattagagcacaacttcaaaatggagagatttaaacagctgtttcatcagctcttgtcagggctcagctgcgtgcctcttctgctgctcacatgtgtagtttctcatgcagttaccatcagattgggctgaagctgccgtggctccaggtctaactccctcatgttcctccccaggggcttcactctatgttgctgttttaaataatcttactttttaagaacagttttcgacatacagaaaacttgggcaatactacagagggttcacacataccccacacccagttttctctgttactaacatcttatatcagtgatgtacaagtgttacaattaatatgcccatattgatgcattgttattaactaaagtccagatttttttcagtttttttttattttttttattttttattttttttagtttttacaaaatgtccttttctgttccaagatctcatctggataccatgtcatatttagttgtcatgtctccttgggctcctcttggctgtgacaactgtggccttgctctttatgtgttgtcttatcctccaggaccacacacacacatgcgggcacgcacacacacacacacacacacacacacacacacacacacacggtagtttggacttcttacttactggccaaaggctctgagatgagggaaggagaagctgtcacattctaaggcctgggctccaaaatcccagaacagcaattcctctgcttcatcttggtccaaccagtcacaggcccagcctagattcaaaggggaagacataagtcccatctcttgatgggcagagaggcctgtgtgtgcaggaagcatgagcagaatagtgagattgtcaagggtcattttagggtcaagccacacacagatgcccggaaaataccaccatttgcttagttgattttaagcagagaatgacgaaatcattttaaaaaattgagaacaaaatggcatattgatattgaatccaaattcctgtttaagctatgtacctccaaatcagtggttgccatagggtatcacattgtaacacaaatacctatttctcatgcaattgaatcactcataaaaatgttgaatgtgccatgtaataaatgtagtaatttgttttctttagtaaatataacaaatgtgtatatttaaaataaaattagccttccattgccatagaattcggaactgtggctttttttttttaagtttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgtcaaaagaggattatgaactaaagtcagtgttgcaggaaatgtcacctgtcctttgaaagaaaataataaatcaaaatggcttttgttcatcatgtttaaaatgaaaaaaaaaaaaaagttgatccacttggagtcttctctcatttcttgacaaggcagttaaataaataaaacggaattttttgtaattgttacttcttgctcatctcaaaaggggaaaagggaaatcttcattcaatacatattcatacagagaaaatagaagagcagagacagagacagaaagagaaatgagatgaagagtgaaacaagaccctggtagagttcctcaagtcagatgttaagaaaggtatctttaaattataatttgtttctttgatagatactatattacaaattcaaaaatgtgaggtaaataaaaacaaaaggagtagataactattcctgaaaaattctaagtgcttgtatattttgctttaagcaaataaagacaaaattaccaaacatataacagagcttgaaattatctgaattcttttgccttgacaatttttttcagttattttagcaataaacattgcctgtgatgagtacataccacttcagagaaagaaagtgatatttctggcttatcgtatggacatcatggccatgctgacaccatttctttaaaaaagtaattgttaatgctactttgtatgtattaatctgaaaatatagaagagcattttaatagttgatgccaccaccataaactccgtttcttgttgctgttgttataatcatgtactaatgataacatctggaatgttaatgtggtgacaaatttagaaacagccatagattgcaaagctggaagataatggcttacgacatttgctctctaatgttgcaatgatatgatttcagatgtgtaataagccagtatgtcaaagaagccaataagcccatcataaaagctatatagaattttgatagagcattatatcatcgctgtgcattttctagtatggtttggtttggtatagtacaggcaaattttaaagtgtggttttaaaattaagaaatattgcagccaggcgttgtggctcacgcctgtaatcccagcactttgggaggccgaggcggacagattacgaggtcaggagatcaggaccatcctggctaacacagtgaaaccccgtctctactaaaaatacaaaaaattaactgggcgtggtggtgggcgcctgtagtcccagctactcaggaggctgaggcaggagaatagcgtgaacccgggaggcggagcttgcagtgaccagagatctcgccactgccctctagtgtgggcaacagagtgagaccctgtctcaaaaaaaaaaaaaaaaaggaaaaaaagaaatattgcatattatttgattttacttattgattttaactgtataaaactataagtcaaatataactggaaattttcatgtgagcaatgtagaaaaagaaaacgaacattctctttatcaagccaggtttaatatgatgactctcaaacaaataccaacactagggtatatgacacagcctcagagtctttttctgtcctttttctggcactgaagattagagtaccttctttacgattgtactgtgagcatattgaggtaaaccacaaaacaggtatcaggttaggagaaaattagcattctatttaaattctgattttgaatcaaagaaaattaatagatggaaagataaatagatgaatatatagatagaacccttagcaaacatttgcatggtttcacagtgctagtatgtctttatttcttccttatttcagatttcctggtataaagagcaattgtttttttaaaacaatttaatggccatgttaattttaatttttactttttaaattttttattattgagttttagggactatttaaattgtgtattagctattaactatgggtcagcttctcacttgtcatcctatctgaattttcactgacatcaaaaggactctttcctttgtagaagcattagtagatcatcttctccaaaccggatacatgtttcagagtttttcaacacttgtgcatataatctactcacagcacccagtaaaagtccaataagtcagtgttgactgactgcttcctatctagttcaaaagtggggagaaaattaaacatgttttcggtacatttcccagcttcaatattttaacttctcaaaggagctaaatgtgcttggaaatggtgtacgacattttaattatgctaccagaagaatccgagaagagtgaacatattgagaaacagggcagaatggaagaagaaagtggcactgctttaaagccaaattatctgatgtttacatctttcaacactttggcccaagttcaagacattaagcctagtttttcaaatgcaattatgtatggaaagcaacaagtatagtcatgcctgatgatagcaggggtcaggctgagggacacaccattctttggtcaaaacatgaaagttaatttcaaaatccaccaggccaaaaagaaatattaaacaaagtttttgaaatagaacattttgatgtcagtatgtttcttttatcttaaaaaacccaatcattttgaaattctctgagtattattcaggtaaagaaaaaacatgctttctcacaattaggaaacaccaggccttgatggatatttagacacagcttgcatgacatttttagctatcacactagcaggtgacatgacagaatatggaagaaccgtagctccttgtgacgtgatttctgtggtcctccctgtttgaagcaatctaaacttaaaaagtatatgactttgccaaaatgaggtgaaaacctttttaaagtgaaagattgcattaaatcagtaatttgacatcacacttgagaagaatgaacatgaataattttttattctgatgaaattcacttgtttaggcagatgtaatgaacacttgtttgttaacaagttattaatctttatgaagagctactaacatttctgctatgattgaacaaaatattatagacatttgggggtcactttcttccagttctctccattctcttgccctttttcttcccggtttcctccaattcacttcccacccatcctcaagagcctataaattggcatcataactctagactaaaatagcgttctgagaactgaaagctcatccttcacccattttctcatactgtttgccaaatacggtttttggcatctgaaattaacattccaacattaacagaaattgctgaatatttaataacatgtttagaactgtgcttgcaatcccttgaagccatgaatgagtaccagccccagatgaaattgtccagcctcatgtgaatcgacggcttccatcagagctgtgccgcccattctcatggctaatcttcccatgaatacttagactgccctgctagttaaagtatggcgcattggcatcacctgggagtgtgttagaaatgcagaactactgaatcagaatctgtattttcataagaccacaggtgacacacgtgcaaatgagagagtgagaagcattggcctggatctatccaccctcctgaaaaatagaccaatgctgtccccaacccactgctctctttctgatgcttgtccgaatggcctccttcacatcttctgtccttttcccctgctcagtcccttctcttttctaggcagcacaaagaggccagttgcacaccccatgggcgtggagagacacctgcctctatcccatgcccctttgtgagtaccacactcacaagactaataatgtttaaggattacttcaataatctaaaaagaaaaattgattttctttccccattttgaaactcatcattttctacatagctaaaatagttgaaattcactattaaacatttgtaatatgcagatttttttacaaatattaccacattgtcttcatgccattgtgtccggaattggtgggttcttggtctcactgacttcaagaatgaagcctcggaccctcgcggtgagtgttacagctcttaaggtggcgcgtctggagtctgtcccttctgatgttcagatgtgttcggagtttcttccttctggtgggttcgtggtctcgctggctcaggagtgaagctgctgaccttcgcggtgagtgttacagctcataaaagcagcgtggacccaaagagtgagcagtagcaatatttattgcaaagagggaaagaacaaagcttccacagtgtggaaggggacccgagcgggttaccaatgctggctcgtgcagcctgcttttattctcttatctggccccacccacatcctgctgattggtagagctgagtggcctgttttgtcagggcctgattggtgcgtttacaattcctgagctagatacaaaggttctccaggtccccatcagattagctagatacagagtttcgacacacaggtttctccaaggccccaccagagcagctagatacagagtgtcgattggtgcattcacaaaccttgagctaaacacagggtgctgattggtgtgtttacaaaccttgagctagatacagagtgccgattggtgtatttacaatccttgagctagacataaaggttctccacgtcctcaccagagcagctagatacagagtgtcgattggtgcattcacaaaccttgtgctaaacacagggtgctgattggtgtatttacaaaccttgagctagatacagagtgccgattggtgtatttacaatccttgagctagacattaaaaggttctccacgtcctcaccagagcagctagatacagagtgtcaattggtgcactcacaaaccttgagctaaacacagggtgctgattggtgtgtttataaaccttgagctagatacagagtgccgattggtgtatttacaatccctgagctagatataaagattcttcatttccccaccagactcaagagcccagctggcttcacctagtggatcccacactggggctgcaggtggagctgcctgccagtcctgcaccctgtgctcgcattcctcagcccttgggtggtcaatgggactgggcgccatggagcagggggtggtgctcgtcggggaggctcgggctgcacaggagcccatggagtgggtgggaggctcaggcatggcaggctgcaggtcccgagccctgccccgtgggaaggcagctaaggcccggcaagaaatcgagctgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggcggtggcgggcgcctgtagtcccagctactcgggaggctgaggcaggagaatggcgtgaacccgggaagcggagcttgcagtgagccgagattccgccactgcagtccgcagtccggcctgggcgacagaacgagactccgtctcaaaaaaaaaaaaaaaaaaaaagaaatcgagctgagcgccggtgggccggcactgctgggggactcagtacaccctccgcagccactggcccgggtgctaagtcccccattgcccggggccagtagggctggctggctggctgctccgagtgcggggcccgccaagcccacgcccacccagaactccagctggcccgcaagcgctgtgtgcagccccaattcctgcttgcgcctctccctccacacctccctgcaagctgagggagccggctctggccttggccagcccagaaaggggctcccacagtgcagcggcgggccgaaaggctcctcaagtgccgccaaagggggaacccaggcagaggaggcgccgagagcaagcgagggctctgaggactgccagcacgctgtcacctctcaccattgtctttataccattcctatgagagagatcagcagctttatcctgacttacaggtttggagtggactataaataaattgggaaggtatcgtaaattagctttttgaaactggaattagtgtcctgtcttaaagtctgcaggaattacaagactcgaggaagagaatcattggtggtttgggaagctctgacaaacaattaagtagagaatgatttagtacacagctcagttcctgaacattctcattgctgcctctggttacaaaaaaatcttgccaagacaaaaatgttacttctgtataaatccctctcattcgaacttaaacataataactaataatatccagaatgatgacttgaattttataatcagtgttaagtggattttaaatacagaaaatttcatgaactttcatggctttaactaaacatgtttgaatatggtaaggatttttctatgtgtatattactatgcagtgtggctctgactctgattgcattcaatattccatctgattaaaccatgtttactcatttctcccctcactagatgcccttcttgaaaccttccctcaatactcctatgaggaggctttaaatgctctgaatctattacaaagataaataccagggaagtcaattttaacaaaccttgaaataacctaaatgtctattagtaagaaagtaattaaattaaaaatgttgtatactcatgtgatgtaatattttgcagctggaaaaaagtaaaatagaatacagttgtttatttggaaaaatgtccatatatgttgctaatttctaagacaaaaaggaaagtttcagaatgaagtgtataatggttgcacttatgttaaaactctatacacccatagcttcagaaacatgaaggtaaatagattaatatctatagctgtagataggttaaaataaagaaaggtggatggatagatgggtagaaagacagaaaggaagtagacatgaagatattcatgagaatttttgaaaaagaatcaaacgattctgataacaaatgttaatttctggggagttcaaatgaaatgtgagaaaagagactttcactttcttctaaatacttttacagagtgtttgaattttttgtaaatgcgtattacacttaaaatttttaattattaatttttgtaggtatgtgactgagtatcccatttttctaagagatagcttattatttttctctctcttctttttcctctcctccttttcctcacttcttacttagctctttagaaatgcaattatagcctcttatctcccatttaccaggcactccttacagggcaagttcatctccagagcagaaccctcacccatcaggaggttgccttgggagataacagttgattgacaacccagcatatgcctgctagagtttttggctgcatttacagcctgtttctgcccatgaagaagccaactcgaatgcccggtagataaggcaccaaagtaagtacgcagccctcttacctgctcccttccatctcccataggtcccccctttaaaagggcccactctgtgctccaaaagggaagcagtacccttatggtaggaacctgtgcttcttccccaaaggtagctttggaaaaaaaaaaaaaaagtcattttctttataccagacctcactctttttaactggactctgcaagtggcaagggactaaacctgcattttggttccaactacagagtaggtatatacacttatggggtaggtgagatattctgatacaggcatacagtgtgtaatcatcacaaaacagggtatccatcacctcaactatttaactttcgtgttacagacaatccaattatactcttttagttatttttaaatgtacaattaaattattattgactatagtcaccctgttgtgatatcaaacactagatctaatttattctatctttgtacccagtaatacacttaaatttttaccattacatcttttcagagtacctagcatttgctttgtatcccaaatattctgcctgtctcattgctagacatttgcattgactcagtcgcttattccccaactagacatcttagctatttctactcactgcctgttgtctgaaatagcttcctacctcgattttgcctttctttgcattttcaaactctaaagtttacttctcctaggaaataaactggttatataaatgtgggtaatcattcattcccatctactgagcataacttcagacattttccctcttagtccaaagagcaattaactttatttttaaattaaatataggttggtgcaaaaataattgcattttttgccattgaaagtaaatggcaaaaaccgcaatcacttttgcaccaatctaatatttaaattacatgcttccaacatgaggcacacaaccttcaataaagatattttctctaacaaccatgaatacatgttaaagattcaacaatgggaagaaatgtcttggaagaatcatgttataggaaagaatagaactaattaggaatgtaaatataatttagaatacggtctctcaagagaattgatcctggacttagccaattattagcatagtgtcccggctgcttcaggactattattcaacttccaaactcttaccctttgaattaaattggtattttactagtttgcagaggactggcagattccttgaaacttgcgccccatcccactagaaatttcgtcttcaggaaccacttcattgcaggcatgccgcagccgcccccgatcccttcccaccgccccactaggcttatgactttaatagagttgtctgcttctgggttatctgcctcacactgtgatggcctcacttccattccatttgcttagcttctagcactgtcgcgcatagaggtgggcacttaataaatgctgccaaccatgtcaaggtaatgagagcagttaaatgagcagctgaactccatttattcagaagtgcttgttgcatgtttactgtgtacattgtgttatatgttaatgggaggctgtaaaatgattccatttattcatcattgcaatgaggccattgaactggatgatctctacagtaattgcacatctagtactctgtgattctaaacgtaaatttccacatgagagaacaaagtttctttccttgatttaaacttatgtatgcagaaatacaatatttgtatgtaaaaatactagaaaatatgagcaaatatttaagtagtatgaaaagtgctaaaggaatctaaagaatttgagagagatgggtggagaatgctttttggacaaggtaggtctttagcagagtctttaagaatgtgatgaatgggacttaatagagtaaatttgaattaattccaagtagtgagtgattggaggagaaatccaatgttcattcttgtcccttccacacccagaaatgaaaccatgacccctttacttagaggtaggatgatttgcatttacaatcagtgataggcaatgcaacaattgacaaaatataaaggtagagttaccatttagtgaaccctaagaaatgcagtagtgcatctggcacaagcgggaaggctggaatttcagaatggaaagaactggggccgggagcagtggctcacatctgtaatcccagcactttgggaggccgaggcgggcagatcacgaggtcaggagatcaagaccatcctagctaacatggtgaaaccccatctctaataataatacaaaaaaattagccaagcgttgtggcgcacacctgtagttgcagctactcaggaggcggagacaggagagtcgcttgaacccaggaggcagtgcttgcagtgagctgagatcgcaccactgcactccagcctgagtgcagagcgagatagagcgagactccatctcccagaaaaaaaaaaaacaacctggagaggaaaaggcagtggtgtgaagacgaaaagagaggagctctgtgtgaaagctatagacgtccagggaagacctgaacacctccactttacagctctatgcttttgcacaacgctggtagaaaagagatctagaaagaggcatgttaatttctccactctccaactcaactctgcacaactgagatttacaaaagataactcgagttaaaggctgcttaaaatctaggtctcttatgtgtctgcttggtaagaagctggacatggatggaggaaatggtagccagggacttcactggttcaggatagcaaatcaagattatttcctagtcaaaaagacaagagtgaagaaagcaatccaacttccccccaagagcatcctagcagtcctacatgagactaactccaggaacacaaatccagtgaagcagtcacgatcatttaaaaaattttaaaaatccgtaacatctttcaagaaaacactaaatttgttgacccattttcaagactctttctttaatgattgctcataaaattttagaagctgacacaaactaatagaaatatgcacaactcagtataccctattccttactaccactaactgaaaacctgaatgagctacactctcttttttatactggattaaatagacattgttattttctctgactctccagaggcaaaactgaacataagctacaaaaatttacattttcaacagaatgcagttttcttttgtataaaaccttctagatatttattctctagcttcatttgttcacctgcttgcttggaaaaaaatgatttataagaagtctctctggccaggttgcccaatgtagttagcaaactagcaagatgaaacagctgagactatctgttagcttcctaattttccaaagatcaccttacaaaccaattaaagtttatgatgaattatgagcaggactatcatgtgtctagcattagaggtcataatttaagcccccaaaaatctatgatattagacaaattatgaattctgagatttgttagcatcatactctgaaaggaactgcagattctctagttcaaatccttttattaatattacagatgtggaaacagttggattgctctgagtgaaaatcccccccttaattgtgaccttaaaattatacttgatgtatccatcctgccaaatgagtaagagctattatgacaaaaaaatataacagaaaagcagaatatttcttctaaatagccacaatgggtaaaacatttccatgtctactaatctagctgacatgtgacactgttctgggccaagtgaaggctttgctgatgtattttttgtctctgtacttctcatagaaactcatacagagatcatgattgaaaaagtttctttcagctgtgtaatttaatcaacctgacctcctaagcctctcaagactttaagaacaggctggccgggtgcggtggctcacacttgtggtcctagcactttgggaggccgaggtagtagattatgaggtcaggagttcaagaccagcctggccaacacggtgaaaccctgtctctactaaaaatacaaaaaaaaatttagctaggcgtggtggtaggcacctgtaatctcagctactcaggaggctgaggcaggtaattgcttgaacctgtgaggcagaggttgcagtgagccgagatcgtgccactgcactccagcctgtgcaacagagactccatcgcaaaaaaaaaaacaaagaacaggttgatgtaattccttcctagacaagatttcagttgaagaactacttgatacggttcatttggagctgttctttgtcccttaattgtaacagacttagatggagttggcttggcaggttataaaactactacagggacagagtactgtggtggtttttgttgaataaaacctgagaatctacttcctaagattctactgtagagatgtatatctgtgtacgtgtgtgtgtatatatgtatgtgtaaaattataaataatttgtgtgtgtgtgtatgtatacacatatatatatatgtatacatacacacacacattcagagacacttgtctttattctatcactacatgaaaaaacatttttaaagctttcctgccgggcatggcggctcacgcctgtaatcccagcacttttgggggccaaagcaggtggatcacgaggtcaagagatcgagaccaacctggccaatatggtgaaaccctgtctctaataaaaatacaaaaattagcctggcatggtggcgggcacctgtagtcccagctactcaggaggctgaggcaggagaatcacttgaacttgggaggcgaatgttgcagtgagccaagattgcgccactgcactccagcctgatgacagagtaagactccatctccaaaaaaaaaaaaaaaaaaaaaaaaggcttcccatgattaaataacaactttgaattgtcaaagcaaaatactattttgtcttataaatttattcttctatcttaaattttaggtctaaatgactgatcctcaaaccacctactttcacaaatgcttttaaatatgttcacgtttccactcacatatatcatgattatgtaatatattttaattgaagtcctcattccttcttttaatcattcatccaacaaaaggtagaggaccactctgtgctgggcacaggcttgggctctgagggttcatcagaggcacagagcacacatttcactccgcgataagtatcctaacacaccgtaaatgagtaaatagaaatgagtaaacgatatatactatcagaaggtgataagtactatggagaaacatatagtatagtaagtgggaagggggacagaaaatctggggaggttgcagtattaaatagggtggccagctgaagatatcagtgaaaggataacattagaacccaaaaaaatgaatgtagtgagggagtagtgggaaaagtggatttcaagtaaggcaccagcaaatgcagaagtcctgaggcaggagcatgtgaggctggaagccactagacaacctaaggagagatgtcatgcggcctaaaaatggaccaaggacatgagcagctacttttcaaaagaagacatacaaatagccaacaggcatatgtaaaactgttcaacatcactaatcatcagagaaatgcaaattgaaaccacaatgagatagcatctcatgccagctagaatggctattaccaaaaagacataaaataacagattttggagtggatgcagagaaaagggaactcatacactgtcgacaggaatgtaaattagtgcaacctctttggaaaacagtatggtttaacttaaacttgagtagaattactcttgacaactgtgttgtcaacaggctgttctgggataaggctgagagtaggtgagactcgttaggactctaaaaggcatgacagtatgcattatttttgtaaaggctgtgtgttagtccattttgtattgctatcaaggagaacctcaggctggataatttataaagaaaagaggtttaactgattcacggttctgcaggctgtaccagtatggcgccagcatccgcttctggtgaggggctcaggaggcttagaatcatggtagaaggcaaatggggagcaggtgtgtcacatggtgagagggagcaagagtgagaggagggaggtcccagactctttcgaacaaccagatctcaggtgaactcattatcgtgggggcaccaagccgttcatgagggatctgcccccacgacccacactccttccaccaggccctacctcaaactttggggatcccatttcaatatttggaggggacacatatcaaagccatatcaaactggaaggcaggggagacaatcagagattttctctgatttggctcttgccatttaagaaacctcagactgttaaaaaacaagtgtgacgttaaactattcagttatgaagcactgatgatttaaacttagaaatcagtgctggctctagaaagaagttcaagattcttcagggcaggagcgatgacaaagcagacaatgttgagcaggctaaaaatcccttaaatggaccaaaagcttcagattattttaaaaaataaacaaacaatgaaacaatagtgagaaatagcatactgatgaacagctaagactttagagtgagagagacctaaattttgattcatgatacttgcctgttacctgtgagaccccgtgataagttaccttacagctctgaggctcagcttccacacctgctcatgctgatagtaacagcaccaaactcaaagtgttattaaaaggatgaaatacaacaattattaaaaacacttaacacagtatctgttgtgagtgcccaataatgataattattagttctcagctacaataattgaaatgtctcaattatttaaaggcaaaagaaactttatttttggaaactgcacaggatcaaaatacctcatatatattacatgaacttgaaattagttactgtcttagaggttcactaagaacacactgctgacaaaattgcaaagaataagcttacttaatcaacctctagttaattgacccaacaattatctgataatctccacttcctctgttcaacaggactgccctgtcatgctgagaccctgtagctggtcaactctactccatgccactgtgcaattttaccctcataagttggggcctatgcatattaagtgctacgtgtattttttcctaagattgtttattccaatttcacttattactataattatatatgctaattagctgtttaataaagtgatgaaatatgagtacaaaaaaggagagttgcttccacaaaaactaataaaaattattttgaagtcttttcaatataaactgtatcactgttgattacatgtgggtaagacaacgacaacaaaccccaactggcatggggaggaatgttccgtaggattctacatctatattgctggggcggtgttaagttgtcattcagcctgaagaaataatagttctaaaattgtagatgtattatgagtgtggcttatgaaaaaaaagtggatcctcaatctgggaacccacattcaaaaatggatctggtctcctataaaaaattaacaattaaatagctgggtgaataataaaatataaaggtatgtaagcatcacttttttatgactttccaatttctcgtctctaataatcagtcagcaagtagacttgattgaatcaggtaagaggacataactttttatctacttgtattgtggcccttccaggcctccacgtgagtgtcagtggccatggagaagcaagattgacaagctgttcagcttcagaagcatctactcctaggccttcactgttgaaggcattccctagtaaccactttcatagtcgtccctttcttttgctcaaggcctgtggctcacgatgaaagggcaggtaaaaatgggatgagtgaggcatttctctaagagaggaaatgtctcttcagctctaagggaggtatgggggtacagatctctccctctttccaagattgtcagtcttataacaaaagatatgaaaacttagtagtttcttggtagaaacctaagcgaaggggaaaaaaatgcaatcacaatccattacataaagagtagataattttgtaaagctctaatacaagcttgcaaattaccatgtgccaagactcccggggtaagtagaaaacgatatgttttagtcatgttaataatatcagaaaagccatgtaaggagaagagacctgttaaatgtagtcacgtttacaaggatgctttatagtcatcaatgaagacttgtgctaattaatgcttacatgattaactcagtctagttttatttaatttagtccgactacacacacacccaaaactgaactgaagcagggaagacattttgcaaaaagactcgccaaatcattttacaatggattgtggaagaaactttctttgaaagactttgtgtaagttttttgaggctatgtaattacggtattgtttgaccagagtatcatacttcctagcataagcttggatgtaaaatatattggagttttgattgaatatgtggaaataagtgaaaataaaacataaaacagggccactctgccaataacatggatattttaatgtactggattatagttttggtcatgtggacaaaaacattcctgttacttaatctgtgttctataatagtattatatttttgtcaggattactctaattcttgtcaactcaagtatattagattctattatgggtcagcagagcatttttccatatttttccaaacaaactattatttatttatcttattttatattttatttatttattagtgtttttttgagatggagttctcttgtcaccaggctggagtgcagttgcgcgacctctgctcactgcaacttccacctcccaggttcaagtgattctcctgcctcagcctcccgagtagctgggattataggtgcctgccaccacgcccagctaatttttgcatttttagtagagatggggtttcaccatgttggccaggatggtctcggtctcttaaccttgtgatccgcctgcctcagcctctcagagtgctgggattatagctatgagccactgcacccagcctaaactattatttattaattcaataagcacactaataggtgaacaaggatgccaccaagtctaccaagcaaagatggagatttgtcccttcagtgatttagacaggaatgacggcaattccttactagttgacctccctttttctttttccctgccaaataatctgctgtcagattttccttctaaaaacagggctctggggtggtcatcctctgcttaaaactctcaacggctgcccattgctccaagctacagtccagtgctcagcctggccccacagcccgcatcagggagcacttacctactgcgaagctgctccccacttcccacctcttctgttatccctacactccagcaggagcatttacctactgcgaagctgctccccacctcccacctcttcttctgtatccctacactccagcaggagcacttggctactgggaagttgctccccacctcccacctcttcttctgtatccctacactccagcaaagctgttgtggctcacctaagtattttatgttcccccaacttgatcgagatctctcttttctcctccatttccgcgcatccaaattctagaccctatccaaaccccacatcttccaagttctttcctaattccccaaccagaagtaatgtttggattccagcagcattttacttgtatcttcagaggatacacgatcactttctacctgggattagaagttttatgtgcataccttgctctttttactgggatgtggtattcctgagagcaggactgatactgctttatctctttaactcttttaatagttgtcatagtttatatgtttagaaagaaaatcaatattcatggataaggtagcaaggattcatttagaatacaaaagacagaagcttagatcagacaaaatctaatgctaactatataactgagtcaaatatttcaatgtgaaaggatgctaaaagatgatttggtctattcattttaaaaattagaaaattaagaagcagaatattaacagacttttttttgcaattctatattgtgtacccccagataggatgaaattttaaataattttcaaaatgtgatcacttttatttcactgtcttaactcattcccacaaacatatcctaaatcatcagctgaaatgacctcaccagaaccagccctcttgttcttctccttcatgcgcctaaccagcacaatgatctgattgtttttctaattttattttgacccgtatacatggcaacaatatggtgacgtggaaaagaacatgtactttggcatcaggtatctccgggttttattccctgctctgttactttcataatttgtagccctcaggctctctgagcttcagtttgctgatttgtaaatttaggatattgaaaagattacaatagctaatattattgagaccttgctaaatatatactgttctgaatgctttacatttattgtctgaaatctcaaaacaactctatgaagtaggcactattattaaccacacacttatagatgaagtagatactataattatccccatatgatagacggagaagtgacggcttagagaagttagctggcgtctagagtcacacagttactgaagagtggagctagaaccgaaaccccgttcttccgacttgcgagcccatgaacaaatgattattgtgaggatgatttgcaaaggccagtcctactgtttgctataaagagtgtttctcaggactcaggttgaatgctgttattttaagtatgtatgagttaattttactccaattacagaaactctctagttgtggggtttaaggaacaaatgttacattctctatcatgagcactccccatctgttgacattaggaatcttagctaatttttcttttactgttgcaatttcttaaagtatggcaactcttttgagttaaattgatagtgcctgtccattttgccaactgaagaatctcactagtgactgaatgtcctggggtgctatcttcaagtttgatacccagtccttcccccacacccctttctaactgccctcaagcagaggaagaaatatcctaccaggtgcaacaaccaccaggtagttcaatagattttgcaaagcacatttttctgaactattcagtagaagcttctaaacatatctttatatgttctgaaacatataaaacaaagcacatttttcagaattattcagtagaagcttcgaaacataactttctctataaagtttgcttgttcaagcttttatgttaatatcatagtttaaatgaatcatattccttaacattatttttaaaaacaaggctttgatggagaaataagtcacgtgtgaagcacaggacgtctttaaaaattagcaaggagggaacagaattaccaaatgcactcatttactggcattttatttctacagacatcagctcaatttcttctaaaataaaagctaatgaggacaatggcatgtccaaatgcctttactggattatatatgccacaagtatactatgtgagtgagccctgtagcaaattggatataatagtgttgattctgtattgttggtacattgggaaggggtttttatagatttgaattttccaggaagattactagggctataagaagatacatccaaccatgctatttgtccttttgtctataaatttgtctttcatctataaaaaaggtgattgtttgtgtgaggagtccagcagaccttacaactataaaacattgtgaatctgtgatccagagaggtagatggataggacaaaccaatgaatcacctaaatagcatccaggcatctctgtgtgtgctaaactgtgccataaatgaaagtaatcatcttctcttctcttcccccacctctctgtaaagtaacctcctgacagaagcttcacctcttcttgttgtgctcatgtattccagatatcagctgaggtttcccaagctccctaaaatctacagaagttcggctcaaacccctatcccagatgctggagatgaccaagttctccagaaacacgtagcaaattccagggtgggaaggagaatctgagcaaggagacaacgattacattctcatggtcacttgtctcttgagctagtgctttattggaattagtttattctgttaagagtttcccaaatgtcctgtctttatgttacactcacaacaaaacagacataaagcactggcttagcctccagttccacaggagcctcatcaacccatgccttcaactgacgcctaagctgagactaaagaagatggtaaccaagtgaagagatggaggtttggagtgtccaagcagagaaactacatgtggaaatgcatcgaagcaagaaagagcatgacatcttcttagtactgaaagaaaatacgactggacttcaaatattttctcattcgtggggttaagaggtgggtgtttctttactcctccttttcaatacatcccaacaaaacatctgtgcacttctttagacaagaccaaaatgcaaatattttcgttgctgttctttgtactgtcaccaaatcaaaatagtaccttagttttgtataattctttacagttttcaaagcaatttccactatctcatttgaaattctcagaggcccctcaccaccaaagataatcagtgaactatctttttcatggatccatttgtgggtttcaacaaaaattaactatagaacttactgaaacatcaaacattttaagaaatgggaaatattatttttttaaccaaaaagcaaaaagagtggtttttcagacacacttattgcatatagcaaagcagctcatttggtgggtgggggtggggtatggcattttttttgtcttacagccacgagaagcagcattttagaataattatttacaaatttgtaaaactttaaaaagaatagactatataacatgttgaaatagaatcattgttacactttgataaaacattaaacaaaacccaggtctcccttttcacctttctaacctcccctttggtctgatgacagtcatgggggtgagggattcaccgggattcaggtaggggctctgggcctgcctaagccttgccaagaagcagttaccagcttggcagtgcatacctgaagaaggacaattgaacataaggctctgttgacgtgcctgtaaattgttctgttagagttggtctatttaaagcaattatgaatgcatgggtcagtgctattggaaaagagcacttttgtaccctttcacaggcctcagaagcagtgtattctccccatctgaccctccggatggttccaggccaagcgtctctcagggaaggctggtttctctcaacgccccctttctgtctgtgtttcttggttaccagacttgcttactttgtactatcctcagagcccatgacttcctctgcttttttccctatggaaccttccttttctcaaaagtgctcacaaccttctctgtgtcttagtgatcacaagactgagcacatttcctgttcgctgaataagctctattcaatacaaataaattaaagaggaataagcaaattgctttaacgttgtgattgctcattaagactctgaaaaatactcaagagcatagacttgttcccttagaaatacgatcaacaggtcattgaaatctttgaacattaagtaactgctatgtgtagaagtgttatattgacattgttactgtggatctcattttctcgctgttttgataatttttactccacattccattaaaattattattttaaaaaattaacacaaaggctttcccttcctctgtgatgggcaccagaccaaagttgatgtgcaatagaaaggaaatattaatcagagtgcaaagcagtggaaagatccccactgctttgcagattagaaatggatgtcaggaagtttcctgcaggaggccatgttatttctttactctctttgtaaagaaacaatttacaaaaaatgttgagtcttgccctaggaggaaggcggtcctggagacaatggctttgccctgaagaagaccatgctgttgaacaccatataaatgatgtggcagtgagagccgaaggctgtgggatctgagagctggctcagcctcactgcccaccagtcatgggatcttggtgaaatcaccaattcctctgagccccagtttcctcatctgtaacgtggatttcataaaaatcacttcttgtattgtaagcgttgaaagcatgaatatacatataatgtaaataatttctcattggataaatcacatgaaaagtactcaataaataaaacattattgtttgttaattcttgatttagagccatctgagtcttttctgtacccttgtagataccttggtcagctccatggagcagagctgagttgacagttttggtggtagtgaactgctaaggaatagaatgtttgatgaactaatatcccctattccatgagtcaacatatccattcctgcaatgttactgagggaaggccctgggttgtcatcactgtgacaatgctggtgcaataattcaatgaattctttctgcttgttgcacagacaaaacaaattcactgagatggtgacactgcagtaaaaaaaaaaaaaaaaaaaaaaaaaaaaaaaaaaaaaaggtttaattaacacaagactggccatgcaagagaactagagttatcactcaaatcagtccctccaagaactcagaggctagggtttctgtggattctttggtgtgtaggaggctagggaatgggtgctgctgattggttggggatgaaatcacagggtgtggaaaatggtccttgtgcagtgagtacgcctctgggtgggaccacagaaccagtcgtcatgagtcacagctccagcttgggtctgtcagttgccagaatgcaaaaatctgaaaaatatctcaaaaaaccagtcttaagttctacaatagagatgttatctgtcggagcaattggggaagacacaaatcttcggacctctggccacatgattcctgggcagtaagggattacagaaactataattctgctacattttagaattcaggcccctctcatgatcttaaacttatggcctttcattagtttctggtccttgagcaaggatggggttggttttagggaggacctgtcgtcatccttgcttttaagttactaataactgaattcctcccatggttagcttggcctacacctaggaatgagcaaagacaaccagcctattaggctagaagcaagatggagtcaaccatattagatttttctcaccgtcataatctttgcaaagccagggtttcactagcacccggtataatgctagaaacagcatagggcccaattgagatctactaacttgaaatgttctgacatacttggtagtaaatttttttagtagtagaaaatctaaagtttaactgttgcacacaaacgttttttttaatcacataggaataaaattaattctgaatggaaatgaaaaataactaaccaagagcaacagatcatctgcattgttatccagacatattcagttgtttgccaagaaactgtaagttaacctttgagaataagaacagtgtctttgttctgtttattatagatggaacagaaattctgtgaggattccccaatgccatccatggaactgtgtgtgctaacatgaatttttaaaatgttgaaattatatttagaaatgataagaaaaccaaataccccatgttctcacttacaagtgggaactaaacattgggtattcatggacactggggactaataaagggaagaaggaggggacaagggttgaaacactaatgatttggtactatcctcactctctgggtgatgagatcattcatatcccaaacctcaacatcatgcaatatagcatgtaacaaacctgcacgggtacctctgaatctaaaataaaagttgggattttttttaaaagaaatgatacaaatggaacagcatttagagagttcatatgcgaggtgcagaacaatgacacttgttttcttcattttccttttgtattatttacgatgaactggaatcctgttcatttatactgtatcatgaaggttttaccagaaaaattttagatttataaaagagaaatcaagactaacatttaatagtttcatacacttaatatgcaagtctgattaagctaataaaggtaagttttaatgtgtatttttgtttagaaatgcttatttatattcatctttaatagtatgggttgaattagcattttagtcgattggataaatgtgaccttcaacttgctgatctagcttttgcttttcctgtattaatttatgaataatttacatttggcccatgggcattttacaatacacaatgacatggatatcttgataaactgctaattaacaattttatcagcaaactttccccaaaacagagcagatatcgtgctttagtaactttgtgcttttaactatgtctaacatagtgctttgcagggggtagcaaaggataaacattaagaaattattaatttccatgagctactccatgaatatttcaaatgtcatttcaagtacttttcatggaaaactaaaaccttgttcttttcatcgtaaaggattgtattcattgtttattagtctatgcatttggactgtgtgacttagctgctgataactttaagcaaactgaaaatttttcaactaaagacaattttcttgtaatggcaaaataaataaaacacatgtaagaaatgcaactcaagcacaaacctttatagaaaatactcgtaataaagtcaacagaagtttttctttaaattgagacataattttctgttgtccaattagaaaatattttaaaaattaagaaaatccattcgtaggaagagcaaagaaaatgggcatggtcatattcttctcgagcagtgggcagtagcataatcctttagatagtaattgggcattaatgtagtaatcattccaaaattgtgcatattttttgacctaataattacataagtagaaaaatttaaggaagtaactctaaattcagaaaatgctttaaagaaaagtgttcatgaaaatattatttatatagaaaagaatcaaagcctaattctccatcagaaaggaaataattacttgtgatacagccgcatgattgaataatgtggacgcattaaaatgcctacaataatctggaaaaatatttaaaattaaattacataaaaaatacagtataaaactctattcaacaatgttaataatactttctttgaaaattgaattatggatttttttctcttttctaattttatgtatttaatatcttttaactactatatatttgtcttatagtttaagaaaaataaattactgagttcattgcaggaatccttttggagattatgctctgaattactttgtagcccaagaggttatatcatgtgaactcaagatagcaaagtatggttttaagagctctcagatgtaagggggcccattaaagattctttgtctaacccagtcaaaggcagaggggaggtaatctgtggaactcctggtcatgtgcagagatctgtgtgtctgaagaaatcagtatgactacagcttaaacaaaaacagatggaatatccgcagatgaactgaatatatagacaaggaacagatcaaacttgcccatgttcctcctcagggaaatggaaagatttccaaaaagtttgtaaagaaaaatgacaagatccgatttacattctacagagatcattgtgattgtttaaaggacagtggattgaatctaggagaccagttgaggagctatggctatagcagatggacgcagtaatggggcctgaattatgatggggagtggcagtggagatggagggaggtagagatatttgaaacatattgtgaagataaaattagcaagactttgtgatggattgacggtgggaaataaatgaaagtgagacatcaagaaatttactttgatttatagttaagaattttgtgtttttttttaaatcacaagtgagtgctgaatttgattaaatactgttttagcatctataatatgattatatgatgttcttatttctgttagtgtgacatgtcgtatttattgatatttaaatgttaaaccactttcgtattttcaatataaatttcactaggttgtaatgtaattatctttttatatatcactattaaattattcatttatgttttgcttaagaattttttatctatgtttaagagagatactgggctataattttctttacttatcatgtttttcttaaggttgggtatcaactggtgtttgcctcataacagtagtttggaagaatttttttctttttctattctttgggagagtttctataaggctgaggttatttctttcctaaatattcggaaaaattcacagttgatccatttatatctggagttttcttggtgagaatgttttttagtaaaagactcaatttttcaatagataatcacatcttgtatgtatttgtttcaattgtgacatctcaggatgtctgttagcttcagttgtaatgagacttttacagaatcctcttcttgtgacctcatacccttgttacaccttgggtattcactgcagtctcttggtccacggctttcagctgcttatcaagtgctttctgtttcagcatctcccgatcagtgttatgacgcatggctgggttatatattataattttcagggccattataaaaactaaccataccattcttttgcttaatacttgcaaaaattttgccatcttctatcttgctttgacatatttttctgccttttaaggtctagctgtctgcacaggttttgccataccttgtaagaatagagctaaaaagtctttgtaagccactgagtgttgttcttataaagagataacaagcgttgcttcaccagcctttttttgttatcataagtaataatttcactgtgcttgtttaccaggttcagattttggagttctgagagattactggttgaatagacttgggctaactcataatatgcattgctaaggagcttaatgaatataccagtaatttgagatctatatttggtagctattgtactctgacaagtaatagcaaaaaaactatcatcaactttttacatgattctgaagtcaccctcacagagttatcaagaattatcgacagaaatgtagttataattaagcatttatcaggctgccctttgacccatttccttgaaaccgaaactcccgttgcactgggtacggaccacttgcatccccactgttcctacaggtaggatttctgaccttagaatcatagggcttttgcttaagacaggatctctgatattggaatcataaagcttttgcttaagagttgcttaagcagatcctgacttccagcaggacaatagaggttaaccagcttcaaggccccaccgaagacctgaatgagcatgagaagatggtttcttcatctcccagccccatgactttgccctgggcaattcagccagtcagtgatctccacactgcagcccatgccaaaacccttaaaattcccagcaccaaactactcagggagacaaattttgaggtttcctcccatctcctcatttggcagccctacaattaaacttctttctctgctgcaactgggtatatctatgtattgacttgccacactcatggggcaaaacttatgatttcaatccaacatgatatgacgacctgacatggcaagagtgggttcagcttgttcagaaggtaaagtgctcttcagccggtgcaggtcatccctccatgagaggagtaacataaacattgctttgcattgtcgttttctattttacaatgtgcctaggattttgtctttaattcaggtatggtaatgccaatagatcaggagtcaactaccattgaaaagatagttggggccgggcatggtggctcatgcctgtaatcccagcactttgagaggctgaggcaggcagatcacttgaggtcaggagttcaagaccagcctggccaacatggtgaaacgcgtctctactaaaaaatacaaaaattagtcgggtgtggtggcatgtgcctgtcattccagctactcaggaggctgaggcaggagaatcgcttgagtccaggaggcagacgttgcagtgaaccaagatcgcgcaaagagtttgtcactcatgattcccaagagaggggcatgacacactgagggccacaagagaagatacaggggcagtcaggagggaaaaggggaggggaaagtatggaccagagccaatactgtccttgttgaggcagtaaatgatcaaggtagggtagaaaagctgagtgggagtaggattgggtagtttgaataatttcagcagactctgggacatgagggtcatccctagttttctggtaccctgccctggggcgatttagggcaggaggagaatgccctgtactgcaggagactgatgaaggaaagtggatgtgggtatgtatttagaactggttggcttgcatattaaagttgtgctcataggaaacttgttagccatctctaggaaattagctaattagcagtcccccacccccaggttcataagtctccaaatatgtcaaagcatcataaaatacagaaagtagaaaatattattaatacagctccattctctttagagatatccatcatagccatgtcaagagctggaagggcaggcttaaagcatgttgcctgcaaacaaagctggcagaaatcagcatgtattcaggtcagctggtttgtattcatccgcagcttgttatagctcctttaaggatgccaattcctctcaggggctgttttctttccacaaatgcattagttaactgatggcaaagcccatcacaagtactgatgaaaagtgaaacctgtgagaatagtgtttccacgtcaggaacagtaggcatagaagacctcacaaacaaaacagcaagaagcctcaaaaggtgttcctgtacatcaggagccccaagcacaatacccagatgatataagttctttgcaaggaattctctactccagtcaatcagttcacaaagctgagtcatttgcccttgagttgagagctgtggttcactggtcacatattgctttggggcagtcatcattcccagatacaacccaagcggtagaggcagctcaggcaggactaggtggccactctgggaggaaggactgcagcaatttagcaaagggattcaaacatttttgaagagtggataagctgatttgcaagggaaccgaggcaataatcaagattgtgtggcactggcaaaaagataaacctgtagatcagttgaatagaattacagttcattgactttgacaacagtgcccaaaatcaatcaatggggaaaaaatagtgttcaccaaatggttctggaaaaactgaatagacacatgcaaaagaataaatttggacccccttgctcatactgtttgtaaagattaactcaaaatataccatagccctaaatatgagagcaccccaaaagcacaggcaacaacagcaacatatataaattggactacattaaaatttaaaaatttaaaaaatttaaaaatttcttgataccatcaagaaaatgaaaagacaatccagagaatgggaaaaaaagtattcgaaaactcatatatctgacaatgaacttgtatttacccacactatgtaaagaactcttacagctctataataaaaagacaaataatccaattaaaaaatgagtgtagaacctgaacagacatttcgacaaagtagatacacaaatggccaataaacacataaaaagatgttcagcatcattagtcattagaaaaacgcaactcagaaacacaatgaaataccaatccaccctcactagagagattataatcaaagaaacagacaacaacgtgtgttaacaaggacgtggagaaactcgacttcccattccttgctgagaatataaaatagtccacctgctttggaaacattttggcagttcctcaaaatgttaaacccagagttaccatatgacctagcatttcaatcccaggtatatacccaagagaaatgaatacatatgtccatacagaagtttgtacatgaatgttcatagcagtgttatccaaaatagcaaaaagtggaaacagcacaaatgtccttaaactgatgagtggataaataaatatggtctgctcatatgatggattattattcgaatcaaataaatgaaaataaaaggaataaaaatactgatacatgttacaacagggatggaccttgaaaacattacactaagtgaaagaagccagtcacaaaagccacatatttatgtaaagtattcagaataggcaagtttataaagacagaaagcatattaaccctaatatctagggctgaagactgtagggaagaaggattatgaggtgaatgttaatgatgataggatttatttttgagttaatgaaagttttccaaacttggattgtggtcatgccatacaactctatgaatatactaaaaaccattggattgtaaacttcaagtgtcgattttatggtatgtcaattatgcgcttataaaactgctaaaaacggtactcagaaaatgcaataaaaattaccttgaagtttgaaaatacaatgatttaaatttatttaaattatatcagattataatacttaaattttatgtagtaatacttatgtttattttaaagttatcaccacttatttaaatatacaatcatgagcctggcagttggttaccaacccaatttctgtgctttgaccaacatcattgaatttggaaggcaatgtaataaaaggtcatgagggccttccacatttttctaccagaaatcatggtgaacctagttaaagatggtctcttatacagttgacaggaaatcctgatctacctggaaaaatctctcactgatattacaagagcatgtcccttcaaaagtagtaattcattgctagagaagggtaacctaccgttttcatagcacacttttttgagaagtccttgataagactcatttctatatgtgagtcaaaatttttccctataagttcacactctcaattatttagtgcccacagtatagggataatgatacagagctcaatagtaaaaatgtatatggtgtctctcctcctgtggctataggcctgacagtgaagaatggaaaattcagataattaagaatcttcacaatgtgtgataacatttaaagccccaaagaatatgaaactagatagagaataaatctgttgataatttctagttttaagtagctatgggtggcacaaactctgtataattgcatataatcctcaagaaaagcctgtacagatacaaatgaaaagacataaactcagagaggcaaagcatgtagtctacggctacacaattaataagcatatatagactgtaaataaaaattcaaaaaatatcacccgcttatgtcaaacacagtaacaaatgttgacaagaatgggtagaaattggaattctcattccttgttgagaatataaaatggtgcctccactttggaaacatgttggcagttcctcaaaatgttagacatagaatcggcatgtgacccagcatttcaatcccagatacacaccctaaagacatgagaacataagcccatacaaaaattataaataaatatatacataggggtgcatatatgtacacatatttaaccagtagtagagtttcaaaataagagcattaattaatgtttcatgccagtttacaaagtttattcagcaaggctcagagatggtcagtggcttgctacgagttaactagctagttcaattagaaccaagactagactccagtgtcagacttttggtgaaaaagtacttagaaatgtatcaagggattcctgtgatataattccttacctttgatgaatactgagatttctgttctaggtcaaggagctgacatcttttgttaactttttttttttctcttcttggtcctgtttcactttaggagtttgaattgtaaattccattataaatattcactgtaatttttccatcttttacaattttccccctttctatccagaagctgattattaagagctaaatgtgcctattcaaatgaactaggaagctaaataattgtacagtggaatccgagccccagttcttttgggaaggtgataatagtctaacctgaccaaccaacttttaaaaaaatccactgagccaatactattcaactgtacttcatttaagtaatgtagatttggaaccagtcaaaactgcctactttacaaaaacacttcttcttaacttactacttccaaattacaaaaagagcacctttcagaatatgtcttcagtaatgagttctgccaatttaaaagtaagaaagtctagcagaatgtgtgaatgccaaaagaagaataatagatgaaattcaagaaatctttaggacttacggtctttagattcagtatttttcatattcttggtacattagctcatgtctttctctttcttgtttctaaactcccaagcaacataatgatgtattgttaaccaatttggtgatatttttacaatcgttagagtactacaggctatattatgtaaaatatttctttgtgccctgttacttcggcctgctttagttttacttcttttcctttatttttaatgactttagtgtttaactctctcaaaagaaacatggtgctagtgaatactgtcaatttcaggccgttaccttcctgggcacaataactggccagaaatgggcccaaactagacccatttaaagtccctttttacttttgagacttttctaaatggagctggcagaacagtttgtttggactatgattctactgaagcatgactctagctgtgtctctccttcaaatgtcatagttacgacagtgaggaccctctggctcctcctctccatttctggatggttttcccattctcctccataaaaccatctggtttggaatcacatattgtcagaccacctgctaccactttgagttgtaggcatctactggccattggctcactcttctcctttccagattttagttcttggcttaatgacttgctttctaacactatacattcattgttcttggtgatttcaatatccacatagataatcttcctaaaacagaccacttggttctctgacttcctctcaagtacacttgttctccccaatttagcatctcccttccatccttatagcctagactgtcattacttataagaacaaacccttcatgatggaaatttcaagcattgcatcctaccatttattgttctaaaatgctcactctaaaacacaatcctcccacctcctcaaaacaaagaactcaccttttcacgatctaatcccctcttctaactgttctcattacccagctgaaattacgtgatcgatattttataatcagtctctcaaccacactttcaactcctttcttctttttcatgctactgcgctagcaaaacccaaacagatcttatctatctttctgctcgccccaccctagcataggtacaggtaaacaatctggacccattggaccccccaagaccaaatgggtccacattaaaacacaccttcctttggccgggcgcggtggctcatgcctgtaatcccagcatttttggaggccggatcatctgaggtcgggagtttgacaccagcctgaacaacatggtgaaaccctttctctactagcaatacaaaaattagctgggcatggtggcacatgcctgtaatcccagctactcgagaggctgaggcaggagaatcaattgaacccagtaggtggaagctgcagtgagccgagatcttaccactgcactccggcctgggcgacagagggagacactgtctcaaaaacaaaacaaaacaaaacaaaacaagcaaaaatacattttcctgaggagtcatttaaagtgcatgaccattaacctcaagttggccctgaatgcagccaggcaatcagctgagcttcccttgcccttttattcttctcccctcaaacctacaatacatcctcattctgttcactgttatctgatgactttgcattctatttctctgaaaaatatggaaacaaggtgcattaatcagggttctccagagaatcagaatcaaatatatgtgtatgtggaaggatggatagatagatagatagatagataatagaaacagacagaattaaggcaagagttgatactgcagtctcaaatccaaaatgtgcaggttggaactcaggcaaggtttctgtgttgccgtcttagagcactattgcttctcctttgggaaacctcatttttgctcttagggccttcaactaattggatgaggctcacccacattacaaagaggaatctgccttactcagtctattgatttaaatgttaatcacatctaaaaaaatcacagcaacccctagtgttttaccaaacagccaggcagtgtagcctagccaagctgatgtgcaaaattaaccatcatacaatgagaagaaggatttctcaagttcccaccatcacttctactcccacggacgacagtgcccaaatcctctctctttccttatgttgctgtgcgtcaggcttctcagcctcagcactatctgtgttgggaggatccttctcattgtggggaagctgtactctgccttgcaggaagtttagtagcctgtctggcctctatccactagatttcagtagcacccccacttgtgacaactaaaatatgtctccagacattgccaaatgttctaacaaacttcccccagttttaaataaactctctgtgctcctagagtcaggccctcaagttgagcatgagattccaccttctctcaggttgttgctccagcaattctcttctcacttcatgctatccccaatttcatcagttttcccctctttgttggatcattcccactatatacaaatatgctttgttctttccccaaaatatctcatagcccactttactttttatctatcccgtaatttcttttgttctgtttgtagtaaaattccttgcaaatgtttgtacttattaccaattatgttgttctttctcaaattcacttcagagttttcccttgctactccaacaaagcagctctcatcaatgtcaccaatgaccctcacgttgctaaatccaatagttcttctctcacttgtcttatgtgcaatatttgacagtcgatcactttctcccccttgacataatgataaaatgagatcttcctcactgtcttgaccacataaattttgagttccaagataatcagaccttgaacctcttgtctatcacactcactcatttgataatcttatctagtcccttagcatttaatgtcacttacatgctgatgaaacctcaatttatatcttcagcccaagctgctcccatgaactccagactcatacgcccttgcccttagttgtgggactttgcagttccttcgtctggtgacagccccttgatttggggtttgatcacatgactttcgttagctgatgagatgtgatgggaagtcgcagggtgccagttctaagcctaggccttaagaaaaattgacgctcctgtcttccaaattcccatagtggttttacattccatgaagacattctccagttatcctgcttgtccaaagatggtaaaagagacattggagtaactaggacctaaccagcagcttagagttatgaactgtgagctcagccgcactcagccgaaaccaagcagctcagtcaagagcgaatcatggcttttctctgcagtcactcagttttggaatcagtttttgggatgccggaatgctgtgttacgtggcattattatggcaattgtaaatgcaccacaactcctaattttcctcctgcacctgttttgccctcaatgatcctcaattctgtggataataattccagccttctaatttctcaggccaaaacatattagagttattcctgacatcactcttcttctcatagctcacatccaaaccattatacgatcttaccttttgtacctttaaaatatttctaccatactcccatttctcggattctccgtggagacgaaagtgaccccaccttggatgctagtctgccacagtcctgtgaatgcctcctgattcctactttacttactctcccttgtgtaagaacatgccaaccttgatgatgttattgcacaaattacaggctgtgacacacctggcattcttgcctgttctgcagggctgcacttagttgtccatacagaggacatacaccctctctctatggtatacaagccctgggtctggggtttaacagtgtggaaatctacctgacctgctactgcccaagaccatgctgctgttcataagttttccaataaattgccctctaccaacaaaccgagtttatctgcctcgttctttggcttctctgttccttctgtgtttggtggtctttttgcatatatggcccttttatgggacattcattaacccgatgcaagctatcaccatctacaaactggagtgtcacaatgggttgccaaatggattccctgattctatttgccccgttccccatagagttgtttttcaacacagaaacaaattgatcttgctgagtaaaaattatatctatctcctgcccaaaccctccaggatctttctgcctcgctcagagtaaaagctaaggccctaacccaggcacgcaaggcctcattggatctgtggctcccaacatcccttatctctccaatctcatcttctgtccttatctcactcccctgcagccgcacccgccctgcagaagacatgtgcagagcacatgcctggcctgagttcttcatgctgacactgctctctactccaaatagctctataacccgcactcccgctgctctcatgtcctcaccagatgctgccttcatgatgaagctctccgtgtgagtcggctagggctgctgccatcacaaagtaccatgaagcaggtggcttaagctacagaaatatctggtctcattgttctggaggctagaagtccgaagtcaaggtgtcatcgaggttggctccctgtgaggcctgttccaggcccctctccttgtcatgtggatggctgtcttcatgctctcttggggtttgtcctgtatcttcacattgtcttcccttttgtgtccaaatttcccctatttataaggacatcagtcacactggattaaggcccatcctaaggtcctcattttaatttcattacctctgtcaagatcttttctccatccgaggtgctgtgagttgcgatttcaacgtataaattttgaggagaaacaattcaagcccaaacaccttctctaatcatctatgttaaactacatcctcatctgcaccttatgtctaatcatctatgttaaactacatcctgtaaaatgagcatgattccaaaaggtccttttctcctttatactcttctctcactatgaatggaaactgtcaggtgtctcccagaattatgtagatatccttggttttaatttatttacttgacagagagaacttgtagttcagacaatccaaaagaataccaagaaagtaacatataatagccttagaaataccaaaagggagtatttattgctataaatactaaaggctaacactctgcaaatcccagcaccttcaattctgccccgtttgtagacaatagacatagaagggaagcagcttattaacttaaaagggaggaggagctgttaacatcactacaaataatataatattgttaggcagagtataataacaataaatctctagataactttgtggccaatatttgaatgatctttgtatttagagatgacagttactatactgatacacaactatcagtgtgtgcttaccttttatgcaaagaatgaataatattttgtaatatgagcttgaaactatcatcttttgatttgtggctataacattcactgaagatcttagagcaggcgatttaacttcttttttcacctttggcctaaaatattataattccatttaagaacttttggtttttaaagaaaggcatgaagcttatagctcatatcttcctaacactccaaataattaatgaataaacaggtataatgcacaaaggtgtagaacaagctttgcagtatgcaaccttttgccaagaaactagaaaaatgatatttatatctgtatatataaacactaaagcatacaaagaaactcacaaatgtggttattttccatatatatattttatatgctgttttgattttcaaaccatgtcaatacattacctatataaaaaatacaaaacttattattttaccttatcagatataaacaaaacatatagacaagaaaaagagggcttgctttcacctcacttctcctgaagcaaattaacataagaaatgagaatcaaagcttgttcctgtgtattttccaactattgtcttcatttttatgagaataagagtataaaaagagtgatgctattttagccagagtactatgtattgtaaactgaatgtttttagaagagccctttttgtattcactcagaatgaggacttatttttgtccccagctgcttttggaagcatgtgcctataatcggagggctgcagatacccaggcgtctgccaggagtccccggaacaaagccgcagaagctggtgccctctgcttgtttgtgttcatgcttggttctggatgttgcttttcttgaaagaattgacattaagtgcagtgaaataaatccattttgtgtgacattaaatatttttatcggctgtgtaatcatatatataaaatctccattcctgatgaatcctgaaatatgcttataaggatgaccacatttattgtagagcaggaagacagcaatgccagttctataaaagccaagttgaaagaagcaagtttatgcatagtgatctggagtgtccttagtttatttttcatgtacctcactttcatcttggtgaccaatttatctatatttgactaatatatgtatacaaaaataagatctgcataatgcataacacaaacatcaaaactataaaggacattataagtgaggtttcaacttaatgcttcatgatttgttgaccctaaatattgctacagatattagcaaagagatcgtagaataagaattttatttggaataaactactctctatgtaatcggctccaaaacttttaggaaaaaatgagttccaagagaagatgaattgtgaaaatttgttgaatggaaccagtagacacaaaaaattgctaaaaaaaaaaaaaaaaaagtttaagaattaggttttctccatagatgaatgacatttcagtataaaacagtcctcacggaattgctaattaagtaagagttatacaagcaaagactgaattacaatactccacttcagtttatccaccaccttagtgcctaacttgaaattttttcatctattaattcagtgttaacctgattaaaattttaaaataatctgataaaatttaatgaaatggtcatctctctaattttccagaaattcctcatgtctatgcctgtagttctataaaattgtagtctgaaatctggagaagagaaagagagggaataagagtaagttttttttattgtgttatttataacaacaaatggtcttttgagtaccaaatatatagtccttttatgcacagggagacaaaattctagctgtttcagtaaatgctcacttgtagataattcaaacaatggaatattccaataaccattttctttatgtattagcagataatttcacagtgaccttgaatcactgcagcattccaaagtgttctgaattatcagagttacagttatggtcaatttagttttagtgctaagaatatgttattaatatgaactatttgaaattgttacattagactaataatctctatacgttgcttattaatgttagaagttcatagatatccttgctgatcatatgtttgaaatttgctatacttgacatttgaaaataaataataatgataatgctctagagatgttcttttgaagcacaagttttgactctttcagaatgcctttaaaaacctttttatattgaaataaatgatcctgtcatggaggctcctcccctggattctcatgcagcctttttactgcatgttatattgcaatgtttgtcgacatgttcatgcctccactaagacatgaagcatctagagggaagggactgcctgtgcgtgtataatgcatgaacacctgttgcatttaattgcataatatggccatttcccatttcagttttatgggtgcccagacttttattcaacaaacatttattgaactcctgtaatatgattttcagagtgtcaggataagaacaagaaagttaaaagatcaaagatccagagatgtttgttgatctccattcagtgtcatctggtgaatgaagtaactaggccataattacaatgcaagatcaatgctacaggggccgactggaatacagagaatgaagaaccctagtgtgaagaagaggtgatacataaatatcaccctagacattgaactagggttctcatatagtggacagagtggcaaacgcaaagatgtggattcagaagaggtcaatggtgtggactgggaaaagatcagtgggcctggatgacagagtgtatgaggggctgatgggagctgaagcaggaaaaggacacagtgggctttgtgcacctctattcttacactgcaggatgcagatgggaaagcaggagagtcagtgaacggtgtggagtattgactggaagcaaagaggaaatgcagaaaaacaaactttacagctgcttattgaaaacagctaccatttatatagcactagacaatttgctaggctacctgcatatactatttaatgtaatccttgcaatagtcctgtggggagggaccatttccactagtttccatttacaggtgagaaaaataaagctgcatggtgctcagtgacttgcccagctatgaagggagaaaatagtacagtctgttttcaaatccggaggcatatgactccaaagtaaattcatatgatcactgttctatgccttatggccaacgtctgtttccgggaacgtgatcagaggggattacaaaacaaagcaaggtatatgtgccctggccactctcctcaggcgtcttgccattggggccggtggcaagtcagaacgtctgccatggagcagcgagcctcagagtgtgacgattgcagtgagtgtgtgacattgaggtgattaactgtcacacttgttacactaaggcaatttttaaataaaggcacatagtagagagttttccataatctgcacagtttagaattttagcggaacccaaaaaccactaggaacaaaagaaaacgtgactacagtaacaaggcagcctatgcaaatagacccgaggtcaccccgaatatgcacttttgtggtcaactgcctgacatccttgctgttttatgttcactattgtttgaagatccatattattagtttgctctcctttggcctgtgaaattgatcttacgaattttcttttcaatctgtttcagtaggcatcctaatttacattgaaaatatatggccagtgaagaaacagcctggagagatctacactcacatggatcttggtgagtacgaacatgtgtacattgtgtttactaatctttcggcggagggcaaaagggagcccagaagagatggaggcctctcaaccatgacatatttggttatgttttccatcatctgatctgctattgcagtcaaaaagcaaagcattaagtagatgttaaaggcagagatgtatttatttatgcattttctggcagccaaaaagtagagatggattaaatgtgtggtcttagagctggatagctacttgtatctatcatcacatgggtttgattttgtggatgggagtctcaatccacatttaattaaactcccttgctctttcaaatgaaagctcaggaacacataaaaaagtgtttgcttttagtgcagtgcttctgtggcttccagaattggatggatttcatcgcatcctgactgatctatctcaacaggaaaaatttaattgattccatttttgcctgtgccttctcttattttattttagagggatttagaatttgagttgtctgaacgcttttgaaggctcagagctccaatttagtgtgaatttatattgtaaatttgcaaaattctagcaataatatgaatgtgagtaaacaaaatgttgatccaaaacatttgatttcataaaagacatttgcatagtatctaaaaattagtgtcaatattagcgtctttcatgaagctctgaaacttccaatagttaaaagagataaagaatatagagaagattttaataagtaacatttccctcatatccccactacccaatgtaaacccaaatatattatgacctgagtgagatgagattagaaatgtgattgaacacaaataagtggaacatgatatattttataatcaaaatatcataaattctctaatttccatttatacagcattgtccttctgaggatctcaaataattttatatcaattcataagacaaatcaacatattaaaagtagaaattacattgttgttataatatgctctgccttgaaacaagcaaatttgtatatgtcaattaacttttatcataaagaataagtgtagattattactcctatcaattttctctaatactttggtgaaaattaatactttttataaatatatccaaatatctgccttttattgctgtctttcatatctccagtctattagaacaaaatatagtctatttcctgatgattaagaattgtaattataaacgcatatttaaaaataaaaaattgaaataagcagcattcactaaaatttagaaaataagaaaaattaatataatcatgcctgaattattactggtatatgaagaaatcacactaaccaaattttatgatccacatgcgaagaaaattggaatattaggcaaacattttaggtcagagcacacaaactgttttgcgtattatttttgttgctattaatgtgaaaaatacatagtttccaagatgcaaacctttgcagccatatgaatcattcctctgatgtcaactcagcccagagtccatgttagagtcccatcatacatctaattacccaaccagtcagggattttggtttttttttgtttttttgaaacagggtcttgctctgtcgtccagaccgagtgcagtggcacaataatggctcactgcagtctcgaccttcgggctcaagcggtccatcctcccacctcacttcctgagtcgctacgattaaaagtgcatgccaccacacccagctaagttttgtattttttcgtagtgatgggggtctcactaagttgcccagactgatctcaaatgcctgggctcaagcagtcctctctcagtgcagcctctgaaagtgcggggattacagatgtgagccaacacgatcccccaggatttttttttaacaatttttttcaaattagcctagaaatattggaaactaatataatgaatccacaagatacatttatttatttatttaatttatttcgtggttcagccatcctatcaattaagggaaatattgatagggtggctaaaccatgaaataaataaatgtattgtgtggattcattatatacttgccaaaatttttcggtgtaattaattatgcaaatattttgtctagtcttaacaaacattaaaacttgctcaccatacgtgaaacagtttgccagatttggacagcagcaagtcctatgagggcaaagtggccagggcaaaactcgggggatcatctggaagcactgccttcaggacagagcctcatcaagctaagctcataactatgacgtgcagaagacattgccctagtcatggtttgtgcttgggcatcgcatgagacctggcttgccccagggctgttgggttccatcagggaatatttggcctgtgcaaacaggattttgaaggagatttgaatggaaagcgtatttacagaggtatgggcagagctgtgggaacccagggggatactgaagcctcctggtagcagcagaaagccatcaccactcctagactcaaaggatcacagctgtgggagacggatgctgaagagaatctgtggcttttggcagagccccactactggtccattattcagtaggaaaggagtctgggaataaatagtccaatctcattattcttgtgtcctctgacaatctgcctaaatttcccattggttacgcctaatagagaagtctgagaaagggagaccattaatgcaagtcattaaaggtcagcctcccagggcacaaaacaagttggaaaagggtgaagacagaatttggttgaacaaacagatctcaaccagcacaccaggcctgctggaggatggtcaccagggctgtgctaagccatgctggacccaagactaaaggaaatatctgtaatgatgatgctgtcttgcttaaaattttgatattgttgtttatcatagttttttgccattgatcttatttttaagatgtggcattacaatattatttatcctgattactcagtttttttggtaaccccttaaattttgcgctcaagatgaatatctcactccccaaactcgaatctcagcccaggtaattggagtcaatatactgcattttgctttctgatgattacccataattttactgtgtgtttcattatgtgtgtttctttcattaatacattgtgaataactcttttaaaacccaagttctgaaaaactgtgtgcacacctgatgtattttataatatgaagtctggagagcatccctgttttctgaaacaagcaaggttatgtatcctgataaactttctttcccggaaactgctgtgtttggatcctttgtttgtgacctgacccctagagatcagctcatccttgaatgacagctggtaaataaatgaccagcaacattttattctgtggcttctctgccccttgaccctgctagagtcgaagatttatgagggcaaggatagcggtttttgttgttgatgttgttgacctcaccactctagcaatacatactgattaatacaacaaatgaattaatcaacaaccatatcatatgggaaccatggatatcagataacacatctccggctaaaggaaaacaggataaccacctcattaggtgctcctgctaaccttttgtcttcttgtttgtgatgacttagaatcagaacattcaactatggaaaaactgggggatttattacaagtggctggagagccttatgaagctacatacaaatgctagagcattcaatttcttttgcttgggacatatctcctcccagctaatctccattcatccatgggtactatgtactacagaatcaaaaggagagcgtggaggaaatgatgtcatgagcgtctgtgaagctccttacataagtcactacagtaaagttggaattcttgacgctgtcactagaatacaacaatttaacacttgactacataaaattcttaaatatctaaagcactgggattttgaattaaaatacatttattatttagaatgtcacatgctttttattagctgttggtaggtatgttcacagtgaatgagacatgaatcgacgtgagctcaaatgtgaaaactagacatttcaattttggactttgttatttgaaggtatactaaggaaagatctctgacacagcagctgtggacaacagtttacaatgatctaactagctcacattagaatttcccaaatgtgtttctgtgggatgttaataggtgatgtatgagggggtgtgtgtgtgtgtgtgtgtgtgtgtgtgtgtgtgtgcatgcgttgatggtagtgaaggtgattacgtggttgaatacttttgctaagtgctgggctaaacagattctttcaacctactgggagcctaatatgattatttgaatctttaatctttaagaaggatgtgcgacatttgccacaaagtatgtgactacagtacccattttcccatagcatttcacaggattttgaattcccagaaaacattttggaaagtgctggtgtcttcaatagtaatacttttagttctgtattagtttccaattgctgctgcaaaaaaattaccacaacttagatacttgcaaccacacaaattaatttcgctgtagctctggaggtcccaattctgaggtgagttttacacaactaagattgcagtgtccgcaaggccgcgttccttctcgaggctctgcggagcagagacgccctggtcttgccgtttccagctcctcagggctgcccgtgcactctttggccctggcgctccaacttgcaattctgtcataagatctcctttttcctgtaaaatcgtcaaagatgctccaagaatcacgtttgaacaggtctcattcattttaaagtaatctcatgtaatttcaaaagcatgttgagtatccactccggggatgactttcactcatgcgatgtgaggtgttcatcccaatgaaatgcaatctagcccttaaataatgaattatttaattgtagatgtaaaattagttcccaggtatttaaacttcaaagaagaatataaatggcctaaaaacaactcacaaaagtgcttcaggggctgggcgcggcggctcacgcctgtaatcccagcactttgggaggctgaggcgggcggatcacgaggtcaggagttcgagaccaggcgggctaacatggtgaaaccccgtctctactaaaaatacaaaaattagctgggtgtggtggcggctacacaggaggctgaagcaggagaatggcgtgaactcaggaggcagaggttgcagtgagctgagatcatgccattgcactccagcctgggcgacagggtgagacttcgtctcaaaaaaaaaaaaaaaaaaaagtgcttgagggtgcacgccaggggtcaaacaatgggtagtgttctgacctgttaaaatttggagaagcagccagggctgagacaacagtgcaaaatgaatgcccgaaaatatctcagttaaacgcaggaaattggtgtttcacacgtgttcctaggagccaaatgtgagagtaaggtataatacatgtgacagaatgggaatgaagaagtctggaaaagcagactgaggccagatggtattttctcttatgctttgaatgaggtaatttgtcttaacatggttggtagttaatttggttgtttataattttttcaacaaataattatgagcacctaccagtgtctaacctcaccctgggtgtagaggtgatggagagccatcaaaggcttttcaccggggcagtggtaaaatcatgcagagctttagaaagtcaattctggcagcaaattcgaataaatggggggctctgtattagtttgctaggactgctgtagcaaagtgctaccaacgaaggggcttaaacacaggagtttattgtcatagtcctggaggccagaagtccaacgtcaaggtgcgagcagagtcatgctccccctgaaggtgccagggaatgatctgtgctgggcctctctcctggctgcctgcagttccagtggcagcgtaactgcagtcctcacatgctgttctctgtgtgtgtgtgtctctgtggctgtgtccaaattttccctttttagaaggtcatgttttattaagtcatattggatgactgtgcccaccctaacgatttcctcttaactgaccatctgcaaagaccctgctgtggtctgaatgtttatgttccccccaatacctatgtgaaacctaacccccaaggtgatggtattaagaggtgggacctttgggaggtgatgggtcaggaggacttcccccctcatgaattgaatcagtggcccataaaagaggcctgacagcactttttcactccttgtgccatgtgggcacacatagaaggcaccatctatgaggaatgggtccctaccagaaagggaatcttgattttggacttcccagtctccagaactgtgagcaatcaatttctgttcataaaattacccagttttgtttattttgctattttgcatgaatggactaagacagaccctatttgcagataaggtcaaattcataggttctagcagttagtgcttcaacatctctttggggagatataattcaacccgtaacccactggaagtggaggatggaggaagtgggaaatctagttaattttcagtggttttggaagacgtgcctgggcagaagtgaggaacttgcagtgtccttaggaaataacgggagcccaaatgagggcaatggcagcaggatgggaggaggtcctgcgtgccatatcgagcatccacaccacagcactatttatcatgaatctgcttctgaaaacttcagcataagcagtacaacttctcgtttattgctttttgctaagatgaaacagaactaaaaatgtgctgaaaactgtaaactctcccatacatttctcatcatgattctctttctactactgaccagataatgaaaataatcagcactatctacacagcacaaatattttcatttatattaaattggatatgctttttcttttttaaaaatgaccagcattgcattttaaagtgactttttttttcttttttctactgactgtacatttctgactttatgtattggcaactggaagatttcaacattattctatatttgaatcaaatgcatatacttttctttccaaatgtaagcaaattgcgatcatctgggagtgaatgtttttaagaatcatgcaatacttagtcttcaagaaacttgtcacgcagaaaatccttggtgtatgaatttttgcagcccatcttatttaatgaatgttctaagaagacttcaaaaagacaaattaaaatcagttgtccctgacaactgaggaatatcaagagctttttaataaatttatttaagactgaatatgggtcaaaatatttttatacccattcttagaactgacagattgtcacatttgttagtgtgggtgaaaataatattatatttcaaaaatcaatgaaaaataaaagttaaattgaaatgtcacatatggtattataagcaattgtgccactcctgcatattaaaattaaacataagcataggcaaccagcccttggtttctgaaagtcttcacaacttagcctgagaaatacaaaaccattttccctcttgttcccttcaccaacttttgactcagatccctttttctttgcttctgaaactgccccaggtcaccccctaggcagccagccagtctaaaagaatcaaagtagctattttacagggctttgctcattatgatttcagcaaaccctttccatgctcctgtttccctctgacacacttctcagaagagagatattggcttacacttgtgcatttgtgtcctcagaaattactgttcatacataattgccttgtatttagagtgccctgacaagattcttcttgctcttacaattagaagtagtagaatgtattttgccattccaatgccaagaacaaaactcaagtctctcaagattcaagattcatggagagctggcaagccaggaactcttactgcaaaggaaagagatttaaggaggcttagaagagaagttgtaaggaattggaatgctaatatttcttgccaaatcaaactttctggaggtataattactgtaattagaaataggtgacattttccttgagatatttatatacagagctcaaatccaaaggaaaagcactcgttttgtaccatctctcttctcaatatctctctctgtctttctgtcttgtccaattaggaaattcagtggtagctaaaacacaactttgcctactttagaattctgtctgtgtctaagccccagaatacaacttttaataactccaagcctccttgaaaaggtgacaacaagacagctttgacattttgtgcacattcatccttactgctgggaaaaccacaaaacctggagtctgccaatggagcatcaataatctttgtgtcataggtgaagaccagtaaaattagcacttaagacaattcttcctggctttcctaaacaaattcgtgaaaagaagtggattcgtctttctctactcttagctcgtctatttgagtatatactttcttctttgaagacatcgttcgttttcatggatttcttatcaacctctttgtggctgacttccagccctttcattagcatggtctgcacgtgtaaatcatctgactcgtttagctttccagctttgtctctcgcctcccttccttccctcccgcttcacccctgcccctctttgtctaggcacagtggagttcctctgatccccaaaccgatgttccttcacattgctgtgcttactattctaatgtccttttatttctctattttcaaaaaatgcattctacttggtagttttctctctatggaagcttcatctgaagacttctatcttaaaacaaatttttctcttttttttaactccagaaaactttgttctagtatttaccatatttcattgaaatgatacaataattcacacagagtagataataaatatctctttaattaattaatcatgtatattttattctcagcactctctttaccaaattgccagggcattagaaactccctcctctgtaacccatagaagctctacatattgcctttatcacattacctggcagctaatcattggcgttgtttctcctcagataccccagacatcacaaactccttgaggttacagcttgtgttgcactcatctttatattctgaatctaacattgtgactggcacagagcagacacctggtgagtattgaatgagtgactaaactcaaagggcagcacatacagtctccaaggtatgtgttatgactgcattaggctgtttttgtattgctataaagaaatacctgtcactaggtaatgtataaagaaaagagggttaattggttcatggttctgcagacagtacaaggagtgtgatgctaccatctgcttctgtggaggcctcaggaggcttacagtcatggtggaaggtgaaggaggagcagtcatttcacatggcaacagcagaagcaagaggaagatatggacggagccacttttaaacaaccggatctctcgagaacccgttcatgatctggaggacagcaccaagccatgagggatccacccctctggcccacacacctcccccaggccacaccccagcattgaggatgacatttccacatgagatttggaggggtcaggcatccaaaccccatgtcaatgacctttctctcccagtgatgtcagaggacacttatcatttgtgccacgctaacctgtgggtacagcctgattcttattttccctttgtttatttactcattttttttgtttgtgaattttgtctctccactgggccattaattaattcattatattagttagaattctccagagaaacagaaccaacaagagatagatagatgatagatagatatatagatagatagatagatagatagatagatagatagacagatagattgattgatagatagataggaggggttcaatattatgagaaatggtttgcctgattctagaggctgagatattgtgctgcctgaaaaccggagaaccagggaaggtgtggtacaaatcagtccagggctgacagcccaagaagctcagtctgtgacagtgggtgtcccagctccagagaaagagtgtgttcgcccttgctctgccgttttgttctcttagagccctccgtgtactggggggtgcttgcccacattggtgagggtgatctcctttactgagtccactgattcacatgctaccccttctggaaacagcctcacacacacacccagaaagaatgttttaccagctatatgggcatctcttaacccagtcaaggtgatgcataaaattaatgctcacactcacctagatcttacagctcacattttcctagcagagaagaatggattgctatagcaatgagggttcttagagactcaggatgttcgccctgcagaaattacctctaaattaatcccagctggaagtcagagagcctctataaaacatagcctgtgttcagccacattgatttttattatgggaaatatatgaaaattcagcaaaggtgacggagtgccttctgaagagaacccagtggagattcttaccaccattaaaaacaagctcatcatcagttcatcttattggtgtgagatttgcttcacaatcttcaaataatgttacagaagatttcatctgaaactacacattttggggatttttatttaggctttcatttaaaacaccgaacactgaataaaagaatctaagcctattatctatatatctatggcaaagtttcttcactttattgtcaaaagtttacataaagttgaaaccagaaaaaaacatttttttcttaactatctaatattggtgagaaattgagagatacttttttttttttttttggatggagtttttgctgttgttgcccaggctggagtgcaatggcacaatctcggctcactgcaacctccacctcctgggttcaagccattctcctgcctcagcctcctgagtagctgggattacaggcatgcaccaccatgcccggctaattttgtatttttagtagagatggggtttccccatgttggtcaggctggtctcgaactcctgacctcaggtgattcgctcgcctcggcgtcccaaagtgctgagattacaggcatgagccaccgcgcctggccgagagatatctttttaccttgaggtatatttagagttgacctcaacataccactgtactcagttgaacagatataattagatttataattatcttttaaaaagttgttctaatactaacagtttaaataatgtgagtatccaattacttggttttattatcctacatatttaacacttacatccaggaacatgcaggttttcttttatgcttagctttgttttctggggtaacaatgaagaaaataatctctagagaataaaagataagaaaccatgaattatctgaaagacttaaggtttatatcatttggagcctgaacttaaatgatgtgtttgcaggagaaaaacaattctagaagaccattctacttaaatggagcttgtactaaagtgttgaaaagctgcaaaatgttgcttatttttaagtttaaggcagctatacctggaataattaccatgacaacttaaggccaagttcaagagcccgagtgaaaaatagaatcagttctataattgattctctttgaaactactaaattcacagttgcagaattgtaccactttaactatattctttgtctgaattatatgcagattgtacaggttatgtgtttttactgtagctttggtatttcatttctggagaagaaacaaggttgtcagtcaaatatcttaaactatgaaatagtgcatggactcacagagctccgcttcacatgcatagtgtgagatgaacagaaagtggccactggcatgacaagaacatctgctacttaaaactatgtggccataagcaagataattaacctctttaaattttcttttttatctttataaataagaatgtcaatgaattccttatacagatataatgataaaatgagataatatatttaaagggtatagaaaggtgcctagcatatttaaaccatctaaaaatagttttgcttttatgtattgaaaagttcggttgcaccaaagtcactgcaaaagtgactagtcaaaggcaagtaacacaaaacttaagaacaattggattacatgagtaagagatttgtagttctccccctacaaatatggagttggctcaggacagagctcttcaagaatgttttcaaggacctaggctcctcatctctccagtcctaacccttggtcgtgactttcatcctcatgattccaagacagctgctgcacatccaatgccatgtctgcattccaaccacaaagaaggaaaaaggataaaaagccaaatatcttcttcacataggaggttttttctttttaatttggaaaaataaccactttctagctaacttttaattatattctattagtgagaagaaatataccaaattgccatttaacacaaagaggggtaggaggttttaggtcttaactggaaacatagctattcctttctctgtatctgttatctgtctctgtctctacctctctctttctgtgtgtgtgcatgtgtgtgtgttgtgtaaagagagacacacacagagagagagagagaaagaaagagagagagaacaaaagaagaaaggagaaggtatattggatagctaaccagcaatgttagccacggttatatttagacaattcgttttgcagcttataagagggcatgcttgaatataaactcatatgacaagcatagttaaaatactttcattcaattttgcattccatgaagcttcactatatactctagtccagtttagcaaggagtgttagactggggctagaatctggacagcctgtgtctgtctctagtttactgcttagctttgtgcaaattacctaattattctgcatataattttcctctcccattaaatgtggaggtcagatgagaggctaccaatttcagatcttaaatttggtggtttcatgattgttatatttctccctattcttttaaaaaacagtttcatattttcaaaaacttaataattttctggaactattgaactttggttaagacagtcttgcagaggttatgtattgttctcagcactgtgccaggctgcatgtgagacacaaaaccagttaaagacatgcccgccgctctccgtgtatgacactaagcaccttcagtgtggccatgactcactgttggtgccaaggttccaagaagagataagtcagaatgacatgaggaatttaaagatggcttcacagatgaatggaactggaactcaatgccatctcactaacatttgaaaattaaatacaaggtagaatgaaaagatatggttaggtggataaaatatgaaggaacatctcaaacaaagggagatgcaccaacagaaacacagatgagaacgcaggtgctatgatgtggatgtttgtctctccaacccctgcattgaaatctcaccccagtgttggaggtggggcctgatgagaggagtccgggtcatgagggcagatcccgcatgaatagattaatggcccccattgggggtgagttctcacctcagagttcccacaagaactggttgttcaaaagaggctggcacctgtgtccacccacctgccatgtcctctcgccatgtgatctctacgtaccagctccccctcaccttctcctggcaccatggtggacgttccctgaggcctcaccagaagccaggcattgtcagcactgtgcttcttgtccagcctgcagaaccataggccaaataaacccttctttataaattacccacctcagggattcccttagaataccaaattagactcagacagtaagcttgacaagttggggccgaggaaggagcctctcccagttaggtgagaaagcatatgctagtgactgataaaaataaggttgcccgaagacttcgtaaacctgtttcctgcaattcttactctaacacaaatacacagctaggaccaggaggctgcttcaccataagtgtctctaccacttgcacacacagtgcacacaagttgaatcagagcaacttgctgtactggacccaggttcctgtgagcagaaagtacaatacactcctcagtatccatgccatgtatccgactcagtgtcactcagtgttgctaatactgtatccggacttagccaactcctggatccagagctggccaaaataagcaaaacaaacaaacaaaaacctacctgaatgcctttgttgcaccttcagttgtgaactaatcagtcataaatcccaacccaactctttctatctcttgcctataactgttcctgtcacttatgcattggtatcacaaatgggagagacctggtgttaattcattgagtaatgagaagccactatggatacttgaagcagaaaggaactgttttacgaagttctgttcctcggcagcatttgaaataaaaaataatgtagtcatctcactaggcagatgagataaaggattgctgtgtctattatcttggagaaagaccataaagacctagattgaggtggtagactttcaagtgagggtgaaaataaatgggatttgagctacagattggaaacacagaatggattggaacagagagtgtgcaactgtctttatttcagatttctatttgcccagtgtttgtccatttttcacctggggaacaggacccagaggtgccagaagtgacattcaagctgagggagggcaccaagtctatatgactgggaggaagtcaaaggtaactctttgtcgtggcagctcatctgacataaatgcaagtatcaagtggggcttttggctagtgctgagatttagctttttcaactgcctaaaatttagatcatggcaaaaacattttagtagggatatattttaggtagttatgcttaaaaataagaaaatggggacatgggagaggttggtcaaaggatacatcattacggttaggaagaatgaactcaaaagacctagtgtatagcaaggttatgataattaatgacaatttattgtattcttgaaaaatgcaaagagagtagggttaaatgctctcgccacaaaataactatgtgagataacgcagttgttaattagctagatttaaccgttcaaaatatatggtaaacaataaatagctacaatgttatctgtcaaattaaaaaaatttaaaagtaaaataaataaggaaacaggcaaacaaaacttttaaaagtctgcattttaatattctagcagtgttttaatctattttatcttatctatagattttgtttctctctatataaagactataaagatatccgaaaaataatctctctgatatctttatagtctcctcaatttacaaactattcgattttaaaaataattgaccatatatatccatattatgttggtatgtgtgtcaaccataatcgtacttttttttttttttttttttttttttttttttttttttcagacggagtctcgctctgtcacccaggctggagtgcagtggcacgatctcggctcactgcaagctctgcctcccaagttcactccattctcctgcctcagcctcccgagtagctgggactacaggcgcccgccaccaggcccggctaattttatgtatttttaggagagacggggtttcaacgtgttagccaggatggtctcaatcccctgacttcatgatccacctgcctcagcctcccaaagtgctgggattacaggcgtgagccaccacgcccggccaaatcttactttttgtaactaatttaatagaggaggaggaaagaaaagtatatgaaagtaccttcaaataatggagtgataattttagttcaagttcaatagttaacatacacttaagatatttttaaagaaacatcacattgtaatcaccagagccttttaagcactggctaattgagaaatatactaagtctccaaaaatacattttttgtgtgactttgacatgatgctgtggtttctctttgtctagaatcactttacctgtgaatcctgtaggctcacatgccactagccaaatcaaacttaacagctcctgggaaatctttaaagattatttcatcaatttgcttgctacatatgtggccttagttaatgttgtaagtgctttttttcccatttcagatgatttttttccttcattgtatttgaaaaaattaactttcctatttaaaaggcaaagtcaacatacagttcattctgagagtatttcttaacatgtttgggtcaaatcttctttgtagatactggtagaactcacagagactccggtaagatgacacatttcccagtacaatttcaggggggttcataaccccaaagccactctatgaaatggaacaggagacacttccagactgtatgattaattagtaatttgtcagatgtaaagatttttattgaaggagggcttgcaattggaataaacataaattatttcccagaactgggagcacgtgtcctgaggaggatgacttgtttgctctgtggaggtgaaagcgatagcctgagccacagcctcgctgagccattgttgctgacgggtaaatgctggaacccttatataccagagggaaccactaccctgcagtctcagttgtgcttctctgtcttcctggatgaccacaaccccaggcaatttaggcccacattatccattcctctttctaccttctcccatccttcatgtaacaaatatttattgtgtctaccacagatcaaacatttgagaaaaatcaaaacagaaaactcctcgatctacagaacttacattccagtgggggatgatagaaaacagaaaataatcatattagaaagtgattaacactgtgaaaaaaagtgagagttagcaaaaacactccctccatccacagtgtggtgggctctctatccactttgacccacatttggtggtggaagtggctctgtgctggtttttggtcccaggactgcaggcctggctgttccctgtccctgagccatgctgttggaagtctgggtgtttgaatggagagtccatgggaaggtcctgagacagaagcaggggaagagggacccaggcctgcaaggccccagccatccctgccaaggtgctgggccctccagataccccagccacgagctggagacccctacagtcattacatggagcagaagatcacccaggcatgccctgccctagagtctgaccgacagatcacaaacaaaataaagtggttattggttgaagccattaaatgtggtgtggtttgctagtcagcagcagataactggaagcttggtggttgtctccacaaaaacaaaacaaaaacccaaactacattatttcaggcacgaccgcagtggccctgtcagttcttcactgcaccctggctgtcggctgtctccgtctctcatttcctacggccctgttcttccggacctttcccactcaattcaaacccaaaccacatccttcgcttttcttacaatcatcacaagacctcgtcttgcattaaaaacaagtatcaaaaatatcctaaatgaatggtgaatacaagtttgagagcctcaaatctttcactataatctcctcctcttttttctctttcttctcttagaagaaaagctgacactaattttcaaggctaatcctcccacttcacttgtaatatcaatccctttgttctcttctacttacccctggtaattattttcaacccgttcctccatcctcctaccttacctatgccaacaagagacctgttctcagttctcatccaacttcacagtggcaacattctttttgaaatactttcttccctggctttctaaaacactgacttttaaaccatccttcacaatgctgcaataatggtcttcctaaaacaagcattatactatgaagttttctccctcagaaactgtcaatggctccctgtagctttctaagtaaagaccacggtcctttcaccgtagtcttagctctccataaataatctcacacagctctttctattttgcaggcctttattcagttgcatgtttcagacaactctgctttccttcaagttacatcttcattctgaaaaccttttcctctcctcctgaatccaacccattcttcaaggctctgctgaggtccacttctccaactcaggcttcaaccaacacattatacactcacccttcttccaatggcattgaacacctgcccctgcattcctgtttagcattccttttctgtgctttgttaaatattctctatcatcttctctttttttttttttcatttagtaatctgcttaacatttttaaggcatatgggataagagacactgggacccatgctaagaaaacagaggcaatagactctgtccatcctcaagaggcacacactctaacataaagacagtcacttgcaataggtttcttttaaaccctcatagaagtaacagttcagtgggagttttgaagaataagtgctcaagactatgtaggaaactcagagacggcttctagaaggaggctatagttgagtctttaaaaaacacatagaaggccgggcccggtggctcatgcctgtaatcccagcactttgggaggccgaggtgggcggatcacgaggtcaggagatcaagaccatcccggccaacataatgaaaccccgtctctactaaatatacaaaaattagccaggcgtggtggcaggcgcctgtaatcccagctactcagtaggctgaggcaggagaattgcttgaacccaggaggtggaagttgcagtgagccaagatcgcaccattgcactacagcctgggtgacagagcgagactccatcaaaaaaaaaacaaaaaaaaaccacataggtagtcaagataaatgaggagggcattctagatgaaaggggtaacagagatgaaaaacactgtgaaatgctgcagaaagtttgggcagcctgctggtgtgggagtgctggatgccaggcaggagaaaggggaggtgaagtggggaggcagcaggaccagatggactatagatgatctcacttgccaggacaaagagcttgacttgtcacaggggaaattgagggtgcagggaggactttcagaggtatagatgggctatgacatgattggataagagatcattctggcaactctggtttctacgtctgccttccccccatctccctgccaccaccacacacacaaattagggcttttaagtgagaaggaactgttaattttacatttgttcctctcctagaagttcatgcaacctcccacatacaataggtacttaataatgtttttattttatgaataaagaggttgaaagttactatgtttaagtggtctcttcactaaatgtgttattatcattattaatcttgcagcaaagggaggagaatagtatttggagaaaggtgcctatgactacatgttctcccactgaccttgcatgggagaaactgggtgctctggcacaattctgctcattgatccaggctgtggggtcctgaggcaagactgtggcccattacacagcctttgagatggcaatgccctttaggaggcaggatttctgcacaccttttcctatgccttctgcttttacacaaggagaaactgatgagtttgcagtggtaaccaccctgttcctaagtgtgatgcctccaaactggtctgagacgtgagggtgaagtcctgtaaagtcctttgttgctgttttttattctcttatctatatgtaagttcaacatctcttgttataaacgcttcaagtgcattaaccctgactaggactcttgttggagagtaacctatatctcttctttgtcataactaagatcagaacctgagatgccttttgggaggaatcctaagacttcctaaatcagatacttttaagtctgctgaaagagatgaaagaggcacaggaactgccctgagagccgactcatccttcacagaaccgttgataggaaagagacctccaaggtcaaagctgcagaaagtgtgttaggaattgcaccttcgagtggtctttgctgagtgttgaatttttcctactttcttctcacccattttatctctgtgtgtaagtgctgctgaaaggcaaaacatgatgcttgaacagggaaggggagtttcccaaataggaggcatatggcctaaattcaggtgcagaccgtgtacatttcagccaagtgtatgacagtgggatcaataaccatggcatgcactagaggtgcaagacccagaggatctcaaattgttccccaaagctcagctctccaaagtcgtggcttacaataggcgactttgtgtgggtgaaactgtaagagcatctctgcacaaggcctttgtggctgcacttttctgcttgctgttccttcccagtatgtatctgctttacgggcaatccccttacttcctcctgttaactcctgggcaaaaattacttctgcgagagttttagaattcagatagggtctgaagagcaagctctgtcgtttatcttacctaacaaaattgtcagcaagagagaagtgcaaccttttcttgatacagctctctcatttggattgtaaaatcttatgttgagggagtgatgaatgggggagaaagaaacataacttctttcagatgtaaagaatgctgactgcttcaaaaacattgctttacctgattttcttggcaaatgcgatttgaaagcaaagcaaggagtagaaaatatgcaggtgtcactttggtagtcacttttgtaggcagagccatcgtgattatgtggtgataccaagtacaggactctgatcagctgcaggtagcacgaaagcctcacctggatataaaattccccagcaagggtggtgagtgtcccggggacatttcataaaaggaagatacatgtgtttctttgcttattgcttgttagtaagtgttgcaaggtgagaggagttagactctggcccttttgagctgtgggccactggtaaatggctgatgccctctgagctcccttttgtctaaataagatatacaataaaatctatgctcaatgggaaaaggtatgctaagccaccactccattactcggtatctggtaatgggaagctatgattactatttcataagctcttttcttcacatgctaaataacaccagcacacactgaaagtacacagaccgctcttttatttagagaagctcaaaattctttgtataattaatcgtatctttctaggaacgatcaaataaacatgacattctcggttgtttccatagtcatttttttaaatcttctaccagctaagtacgtcaataatttaccgtcattttacttcagattcattcatttattcaacaaatatttattgagcacgtgccaatggagcacgtgctagtgccaggccctgttcacagtcaggaaacccaagcccatgcttttgcggagcttatgttctgctgcatgtggacatggggatggagggagtctaacagtctacgagtaggaaatacgtagtaagtctcacagcggtaagagccatgggaaacagggcagggcaaggatagagcaagcacagaggcagggctgggactgtttatacagggtggtcaggaaaggcctctccagcaaggtgctaaatgcaattcaagcagagacgacgtaaaggaagcttaattattttaagaacattataagctaccttgcagggctggagataagggaacgtttcaacttgcaatctggcgtctggtgtcaaaagctggcctgaaaacatcagccatttctgtgcttttctctgtttctcaggccccggcttcactgtgtgccaacagccaacagcacacagcccttcggggctgaaactctgcactgtctgtgagtcatggtggatagaattccaagggtctatatttgtcttgggtaaaataaactgtcttttctaaatatatgccttaccacttcccattagccaaattccccaacacatatttctgctgggaaagctgaacgcaaactattttgctcatgtacagtgcagccagcttccctgtggctctcagaggagacacaaagctaagaatcgaaaacgaacatatctgatgacagaacaaaggtttaaaagaccttgctatgctggaattataacaaaatcaacatcatgaaattaggaaagatatggagagggtgcagcatttagattttcgaatggcacaggtctggaatgaatccttaatgaatatcaagttgtctgaaataagcagagatcttccattgtgtaaaaacctaatatgtcagttacttggtgatcatatcttgctctacctcaattacagtgctgagacaatatcacaatttattgagagagtatttttattttgttaggttgtaggcttcttgaagtaaagactgtcttacctttgtatccaagaacaattcctagctaagaatatttcgatccatttattcattgaatatagtaaaaacatcttattttgataaagaagtatattatacacataagatgagacatgtctgcaatgcttaggtacacttgcagtattgtgtccacatttggttacatattgaagtgtgtgctttggaatatggccagagagagctgaaggctttaaacgaatatcacataagaaattattgcatgaaatgaagtgtttctaatctaatggaaaagaagcttttggcagaaatgatagctgtcttcaaatacatgaaaagttttcacacggaaaaacaagttgatgtgttctgcgtagctctggaaaaacgaccagggccaacggattgaaggcagatttcatctcagcctgaataatccaaaattaaatgagctgcctccagaataaggagatgcttccctctccagtgatgagactcccatttctggaagtgttcaggtagaatctggactggcatctctccggaagtcctgccttaggtgggatgctagaattaaggggccctaatgctctccctaactgtgatgagctaattataacattactcaggtaagcaattccttcagaaacaattacatcttacagagaagagttatcacttttcaggccattatttttagatttttttccttgcaaacttcgtttatttttgacctaaccataccattccactgagcaatattcatgcttggggttttgatgctgattttagacaatgtggttgtaaactgcatgcatttctaggtggtactagaggctagtatgtcaccctgctcaaaatttcccaagacacttggtgtcacattgctatcctcagcatgccaagagacgggttctgtgaattcatgcactgtctaaagcttctttgtcacagattataacctctaataagagaatagtgtctttttggcacttgtgagtaccttgttgctcaagagtagattacccattcatttgttcaacaaatgattcacttaataacatttattgagctcaagtgcatgtgttctaaggatacaatgccaagatgtccctgcctccagcaatttccagcttagtagggaaaacagacctaagtccagacctttaggacacactgtaacatccgctgtaacagtgtttacacaagaccgaacactagcaaaaagaacagagctgcagattctgggtagattcaaaacaatgccatggaggaaaccttgaaatgagtctcaaaagataagtcaggtattttttcgtgtacacaaggtcatttcagcaaagagagaaagtgatattgtcatggagaagtattagcatagaatttgcattggctgttcaggcaacactaagtagcctcatgggtcagttgtgaagcttgggtggtaatctgcggaaatattgtcgagaaggaagcagggaatgaatcatacagtggatagactgaaagtaacaatacgaggcaggaaaactactctgcagattatttcaactgtccacatgaggtaatgacctaatgcatcggaagtgggttttaaaaggagcagagagagtaaaggatatatgtttaaaaggtaaaattgggaggccaaggtgggtggatcacgaggtcaggaaatcgagaccatcctggctaagaccatcctggctaacacggtgaaacctcgtctctactaaaaatacaaaaaattagccgggcgtcgtggtcggcgcctgtagtctcagctactcgggaggctgaggcaggagaatggcgtgaacccgggaggcagagcttgcagagagccgagatcgcgccaccgcactccagcctgggcgacagagcgagactccgtctcaaaaaatacataaaaaaaaatttttttaattaaaaaattgaaaggtaaaattcacaggacgcattgagaaactaccaggtgctatactagcattgaacaagtaaaggtgaatatgcacaacacttcctcaagcaatgaagatgttcttggtggagacaacaaggcttcggcaccagagagtgctccgttcaaatctctgcttttccatttggaaaatctttgtttcagtttccttaatctgctgcattgagactctttcctcactttctctgtctggaaaatcacatgcccctgtcatggttacgtcttcagtggaccctttcctccaaaagcctcttccctcaaaagaaaagtcctgcctattaaggcaaattaatatggaggctaggcctgaacaacccttgagcagacatagccagtgaggcctcatcagtgaccctaaccctgcttgatcggcaaacagaagtgaaagttaacttgagctatttcttgtaaacgcctatattaaataaaaacggaattcaagcccaatcaatatgaagcagccaactaacttataattatagaagcagggactttccaataaaatagaccacataaggaaaactgtataactgcaaacaatcaattttttttcctttattctgtgctcatcctaacccagttgtggtttggagcttcctgattcattaattgctgtttgctcaaataaattctccaaaatgttcttgtgtgctgtttacttttttttttttcttttctttttttttttttttttttttttttttgagacggagtttcactcttgttgcccaggctggagtgcagtggtgaagtcacggctcattgcaacctccacttcctgagttcaagcgattctcctgcctcggcctcccaagtagctgggattacaggcacccgccaccatgctcagctaatttttttgtatttttagtagagacaggatttcaccatgtcagccaaactggtcttgaactcctgatctcagttgttccaccctcctcggcctccaaaagtgccgagattacaggcgtggcgtgagccaccatgccgggcctccgttttacttttaatatgcctaaaggatggcataaaacttaactgaggcaatgaaaaacatgcaaataatagagatgtgggccagagtaagtactcaaaaaaataaagactaatgaggcatcttttattttcttttttaaagatagcatttttaatagaagatgaacatgggcatttttctgaatacataacaatgtatgtttatttcttttcacatgttagtcccatcaaaataattattactttatatgctaggatatgtaccagaacattaatttttgtaggtttcaagttattttttggactactttatcagtattctctagaagaagaaaaaaggaagaacaaaactcaaagagaattaaaaaaagaaaggataaataataccaaagtcagtgtatatttgatttctaaccttattgtatttatatttcaatgaattctaaaatgcttctcacatatttctctttcaatgctgttttttcttcttttactgccatgagtaccttgattcttcaaatgactttataaaaatggctatattaattaagaatatgcataaagatgtcttagatatatccctccattctggaatttacagttgtttggaagaaatgttggctacaactaatcatacagaaaaattttacttcattatataagcaaagacaacgtggtttgttattagttttaaggatcttaaatcagtattactccaaatcttgtccatcttgagctaccttgctcatctgcatttgctttgggatgctttaaaaccagcatgtccaggtaacctgacttagcatccaggaatgcagaggcaataggaaagagaacacattggctaggcacactcttatctagctcctggcctttggtccttctgattgtgagttgtgttggtagaaaggtctaaacaaatgcccagaatacttattcatattaatagtaaagaaatgaatcagcacgatcaattttcattctgttatttcatctcagtaatatagagaaatacattctaatgcagaaaaataaggttttctagtgccatcttctcttccaatgacggagctattgaagttaattctctaacaaaagacagaagcagcagcagcagaaaaaatgaaatatcatttttttttttttgctcgtttcaaattaaagaactcagaatgtttacttatgctggataaaatatacccaaatgttaccttcactaatcaggagcttaattctgtgtttaaagatcaccccagctgcaaattcatctgaggagctgaagcagggagattttaaaaatctaattatttttataattattttcaccaaatgctttatacctctatttggtggctggttcctgagaactccatatgaagtcaggtcagctttgttcacatacacccttctccatggactagccacctaatccaccctctgattaacggagaggcagaatgttcgcaatgtgtaaccagatatgctggtacatcaatgactactgtacacccaagcattgggaactcagtcttaaaaaaatctactgcccccttattagttttctccttagtgaaatagtcttccctacattggaatatgagcagaatatatcccactgagaaatgagtttgaatataatgggagactggctctgtccaatgcccagaccctattcttcaacctgacaggtgaaaattcttatcttgggttgtggaggaaaaacgaagcagggggaagggcaaaaactgggtggcgaaatgggggcagccagggcagaggaagcatgaaggctgagtcagtccccacttcctagtcttctccagacccacgctctccaggttgggttgtcacgatgatggactgggactgacaaccagcatctccactgctgccgtgggagtcacagtgagcacaagacccagagtgtgcagaagtttttaaatgcaagtggacaaccataaccagggggagtcacctgttgcccaggttggacgggagagtggaccatgctatcaggtgactccatattttattcaaatgaagtttttggatctccttattgcataatgtataagggagagcaggggggctactagttgttttatattaacagttgctttagtctttgggaaaatagcaataatattctattgctggagcatataatcaactgcttccatagattcaccttaggaatttttcacccctgatagaattacttgacattatgccattaagtcataatgagcactgttatgcaatcctttaatcgttttaacacatttattacaggggtgttctggatgatatttaccatattacttagagtcttgtttgtgggtacctcttaaattttaatttgcaaaagaaaaaaaaatcacctaggaatccaattaaagtgtacattctgatttagttggtctggatggggcccaagattctgcattgatagcaaattctcagtgacgctgatattgctgtcctgtgctacactttgtacctggctttatagatatcccatcgtagaaacttactctcggaaaagctctgaatgttgaacaagtggtttgtttttattatgcagtactgtgaattgcattgagttgggccatatgaaatcaccaatttttgatcatatttgacatatattgggcaatttctcatgaattgcattgagttgggccatatgaaatcaccaatttttgatcatgtttgacatatattgggcaatttctcatactgtagatatagcatgacaatagcatagtatgctaattcaatgtttctctttgagttgatagctatggagcttgtaaccaaaggagtgacccacctaaagcgaagtgtacggaaccatttacctggggcatagtttaagttttaaaatttataaaacctttccctcttttataagtgagaaatctttagttgcaagtaatagaaatctatattcactagctgaagaaaaaaaaatgtagacttaagtatttaggaattgcaggtttagaccgtctcctgttggcacaggtggatatagggacctcaatggtgacatcaggcttcaggcttcagcttatctgcccaatctctagttttgtttgcttctatgatgaattcacttttagcagcttctttctccacctagattgttccttgtagctcctggattacaggccatcttcttagcaactccaacagataacaaatttccccttccaggaattggattttattagacttgctttggccagagaaatggaaagctcaggttagtaatcttggctcccatgccccctggacctgggtcaactctgtcagatgtatattggctcagagttggcaagggattattctcctagagaaaactgggtagctattcccagaaaaaggaagagtgttcagagttgttcccaggatgccttttcttgcaggaccgttatccatgcccagcccactgctgtcagcattgacctgtgagttgctctgacagatggtatgtgagcagaagatgtgtgtcacttctagaggaagtttaaaaacccgaatgtgcttctctgtgctcccctagcccattgcaatgtcccaggtaagggcagcttcttcagcctgggtccaacacatatggatacatcttgtgggtaagaaataagcctctgctgctgtaagccactgcttccaggacttgcttgttattaaagtaattcttagcctaacctgactgataaaataggcagaaacaacagttgttcatattattccactcatctcattccaacatgaaaaccaattcttctttgccaatataaggatttcaaaaacaccccaactgcatttaatttatacattaattacaatctaaaatccactcacttcctcctcaaataagaaaattataaaagtctgttcacttactgtccaattactgcctaagatctaagttcaggatcttttggtgatgggaatttatctaggtcaagtccagattagcttctactggtggagatacctatggttgaatggggtatttaaatatatttaagtaacatatttaatcacctcccaatacatataagattcagtagtggaaatcaaaaggactaattataaaactaaacaaggtaaaattcttttttgttgaaaaggaggcaaggaaaacagcagaattgtatggttaagtgttcatggcaagttagcactgcagccctctggcagagtgagctccttggttagccagcccatctttcctgactcctctctctgtgaggatcttctttatttattgacctcccatgtcacatctgagatgacattggagaggcctccctatctgggttgcccacattagctggtatcaggctctatccaggcccccactagaactagaattttcaattaaagcttcagatgaggagaccaaagttacccatcccttatttttagggtgcatcttagtcttggctttttacaataaagacctttcccaggaggtgttcatggtgagctgaagtatccgcccctcctgaggtctcctcttggcttcccccatattcccttccttactgctttgctgaactcagcccagtgactgagcccagcgcagagaacccagctttgcatcctccaatactccagtctctcagtgctcacaagtttcctgccccaggccagaaaaggaacccttaaagacaaaatgaaacgaggccgagtgcggtggctcatgtctgtaatcccagcactttgggaggctgaggcaggcagatcaccggaggtcaggagttcaagaccagcctggctaacatggcaaaaccccatctctactaaaaatacaaaaattagccaggcatggtggcacacacctgtagtcccagctactcaggaggctgaggcaggagaatctcttgaagctgggaggtggaggttgcagtgagccaagatcgcaccactgcattccagcctgggtgacagagtgagactccaactcaaataataatttttaaaaagacaaaatgaaacctatttttgcttttttttttttttttggctttatgttttaacatgatccagttttaactaaagtgaagcttgtctctttttatcaaacctttgagaattagtcaatatattccaaaatcctgtgaattttctaccatgttaccaatctctagcctaggaatgtgtatgatatggtttggctgtgtccccgaccaaatctcatcttgagttgtaactcccataattcccatgtatcatgggaggaacccggtgggaggtgattgaatcatgggggctggtctttcctgtgctgttctcatgatagtgaataagtctcacaagatctgatagctttaaaaacgggagttttccagcacaagctctctctttgcctgctgccttccatgtaagatgtgacttgctccttcttcccttccaccatgattgggaggcttccccagccgcatggaactgtaagtccaattaaacctctttcttttgtaaattgcccagtctcaagtatgccttaatcagcagggtgaaaacagactaatacagtaaactggtacctgaagagttgggtgctgctgaaaagatacctgaaaatgtggaagcaactttggaactgggtaacaggcacaggttggaacagtttggagggctcagaagaagacagaaaatgtgggaaactttggaacttcctggagacttgttgaatggctttgactaaaagcctgttagtgatatgaacaataaggtccaggctgagatggtctcagatggaaattaggaacttgttggaaactggagcaaaggtaactcttgttatgttttagcaaagagactggcagcattttgcccctgccctagagatgtgtggaactttgaacttgagagagataatttggggtatccggtggaagaaatttctaagcagcaaagcattcaagaggtgacttgggtgctgttaaaaaggcttttagttttataagggaagcacagcataaagtttagaaaatttgcagcctgacaatgtgatagaaaagaaaaacccattttctgaggagaaatttaagctggctgcagaaatttgcataagtaacaaggagccgaatgttaatccccaaaacaatggggaaaacgtttccagggcatgtaagaggtcttcacagcagcccctcccatcacaggcccgaggaccaaggagaaaatggttttgtggtccaggccctgggtccctgtgctgtgtgcagtctaggtacttggtgccctgtgtcccggctgctccagccatgactaaaaggggccaaggtacagctcaggctgttgcttcagagggtggaagctgcaagccttggcagcttccacatggtgttgagcctgcgggttcacagaagtcaggaattgaggtttgggaaccttcacctagattccagaagatgtacagaaatgcctggatgtccaggcagaagtttgcttcaggggtggggctctcatggaaaacctctgctagggcagtgcagaagggaaatgtggggccagagcccccacacagagtccctactggggcactgcctagtgaagctgtgagaagagggccagcatcctccagaccccagaatggtagatccactgacagtttgcaccatgcacctggaaaagtcacagacgctcaacaccagatggtgaaagcagccaggaggagggctgtacctgcagagccacaggggcggagctgcccaagatcatgggaacccacctcttatatcattgtgacctggatatgagacatggagtcaaaggagatcattacagagctttaagatttgactgccccactggatttctgacttgcagaggcctgaagctcctttgtttgggccaatttctcccctttggaatggctgtatttacccaataccagtacccccattgtatctaggaagtaactaacttgcttttgattttacaggctcataggtggaagggacttgccttgtctcagatgagactttggattgtggacttttgagttaatgctgaaatgagttaagactttgagggactattgggaaggcatgattggttttgaaatgtgaggacatgagatttgggaggggtaaggggtggaatactatggtttggctgcgtcccctcccaaatttcatcttgaattgtaacttccacaattcccatgtgtggtgggaggaacccagtgggaggtgattgaatcatgggggcgggtctttcccatgctgttctcctgatggtaagtctcatgaaatctgatagctttaaaaatgggagtcttccttcacaagctctttctttgcctgctgccatccatgtaagacaggacttgctcctccttgccttctgccatgattgtgaggcttctccagccatgtggaactgtaagtgcattaaacctctttcttttgtaaattacccagtctcgggaatgtctttattagcagcatgaaaacacactaaaggccgggcaaggtggctcacacctgtaatcccagcactttgggaagccgaggcaggaggatgacaaggtcaagagatcgagaccagcctggccaaaacaaaaattagctgggtgtggtggcgcatgtctgtagtctcagctacccaagaggctgaggcaggagaatcacttgaaccgggaggcggaggttgcagtgagctgagatcatgccactgcactccagcctaggagagagtgagactccatctcaaaaaaaaaaaaaaaagaaagaaatgcttatttattttggaatcttctgtgatccctcatatagtgcctagcacatgccctgtactagttaagcaaatgagaagaaaaatgcttgtaagctgcatgagggccccagttacacctatcttgctcagaattatgcctgcagggcctaacacaatgctggacacacagcaggtccacaacacatatgtgagaatgaatgtgtaaacaaatggctttgtgcacaatttcataccatctacaaaaacgttttctacacgcagcatctccttagtctacacaggaatttgggtggcacaaaggaggttatagaagactcttagcaaggtgaaagatatttcaagttggctgggtacggtggctcaggcctgtaatcccagcactttgggaagccgaggcgggtggatcacgaggtcaggagatcaagaccatcctggctaacatggtgaaaccccgtctccactgagaaaaaaaaaaaaaaattagccaggcgtggtggcgggcacctgtagtcccagctactcgggaggctgaggcaggagaatggcaagaacctgggaggcggggctagcagtgagccaagatcccaccactgcactccaacctgggtgacagggcaatactctgtctcaaaaaacgaaaaaaaaaaattcaagttaacaaagtgacaatctgtatgcacatatttaggaagaaaagatagactgacaatctacctcaaagggaaagcaaatattggaagtttcatttgttgctattctcttctctgtttttggtggatcttttacctggaccatgaagtggttttctgcaaggggagtattgcagtaaaggcacgtacagacagagatgagaacataactgaggcacagagggagagccgtggtgacagatactttctgtccttggctttacttctgggggagacttctttttcacatactcctggcaattattagtccaacaaatccatcataaagttttaggggagatgtaggaacattcagtcccggtatatgcaatcattatcctttgggccgaatctcctctgagttaattaaattcaaataagtatctttccattccccgggacttgggaggaggagtccaacgcacttgagaagtcacaaaacagccattagatgttaataactaagaactgttccaacctctgctggttttaaatgagaagaccagaggcataaagctccacagggcattcctaacttcctgaggcactcagctgttgaaaatcaattcctcaaataatagtttcctcttccaaaatttagctggatcagatatttttagtttaaaggtcctaatgagactttgtaggaacacgcacagcaagggagaatcctgcacgataaatcactggaggtgtgccaccttacggctggaaatttgaataaacagctttgatgatttatagcagatgtttttccacttagttgtagcccaccaaagcacatactaggcagcatactccaggagaatgggaattagaaccatttttgtgtcattcgccactgtctaaatggcacctggcagtgtctggtagatagtaggtgcccaacaaaatttttctagtggacaaatgacagttctatttagacacaatgcagtctcctctggtcagtcctaggaagaagagggcattaaatcacgtattggttttcaggcacaaagaatagtggacctattttgaagtgaaaatgctattgccttggtaaattcttctgtggggctagaaagaataaactagaagtctggggagttgcacggttcttctgaaggccttctagacctactctttatagatagattgccttccaaacatagcatgtttccacatgtatttctcaattattagttacattacttctgcctattcttggaccctagcccagtgtctttaagtttgaacttaataagtgttcattgaataaatgctgactcatatctaatagggcatatgttccaaatttacttctaaccataaagatgtgttttttctgcatcaagctatccttgctgtcagtcctttttgtgaccaaagcctttattggaaagaagattgaatggacataacagtacgatcaacagatgtgatgcttggcagtttccccatctctgcctgtaactccagcactttgggaggctgaggcaggtggatcacctgaggtcaggagttcaagaccagcctgaccaacaaggcgaaaccccgtctctactaaaattacaaaaaattagccaggtgtggtggcgaatacctgtagtcccagctactcgggaggctgagacgggaatcgcatgaaccctggacgtggaggttgcggtgagccaagattgcaccactgcactccagcctgggaaacagagcaacactccatctcaaaaaaaaaaaaaaaaaaaaaaaaaaagacagaaagaaatagcacctaattcttattagagttattttgcagtctaaatgatttcatatacgtaaagtaaatagaatgttacctggcacttgaactctcaataaacgcaatttcagtatccacaatatgtattattgtatattatcactgtagttccaagtgatcaccacaaatatcaaaactaatttatgttatataatcccaactggaatcagaagaatgctttgggttatcttgggactctgcaaatacttaagtttgagaaacacaaagaataaaaaaatctaaagagaaccagaatttatgtaaaataaaaattaaagtgaatacgtattccagttgaaaggagaaaataagcacagagagttctcagggtggaatttatgaaaaacatcttcaccttcatcagcaaacacatcttttttttttcttttttttttttctttttttgagatggagtcttgctctgttgcccaggctggagtgcagtggtgcgatctcggctcactgcaacctctgcctgggttcaagcgattctcctgcctcagcctgctgagtagctgagactacaggcatgcaccaccacgcccagctaatttttgtatttttagtagagacggggtttcaccatgttggctaggctggtctggatctcttgacctcacgatccacccaccttggtctcccaaactactgggctcacaggagtgagccaccatgcctggccaacaaatacatcttaagtactaattgtgtattatgacttgttaagttttatcaacacggagaaaataaacttggccattgtcgtcaaaggaatggccattgagagtaaaacagtcggtcactcaccacgtaggtcccacactgcaacttgtggaatagaaatacaggaaaagtgcaatgcaatgtgaaagatcacaaatgttcctttagaagggttggagacagcttcaagagaaaaggtaacatttgggttgggccttgagcccatacagatatttatgtggtgtagaagaggctgtggtggaagtggggaagaagagggcttctagcaaaggagcagagaggaggagaggcctgggtcttaggaaccaccacatgctggcatggccagattttcagtttagtgaagagagggcaagggctgcaactggaaacatgcaatgcatttcctgtgccctggtaggcaatttgatcactatcttactggcaatagaaagccaacaaggcctcaaagcaggcttggaaaggatgactctttttcaggaaaaatagcctgtcagtagtgtggaaaataaattagaaaaggggagcaattaggtggtgagacagttgtgacaataatccaaacagtggcaaagccaattgttgaatctctgattcaggcctcaagacagcattggaacagacagaaatggagactaattgcatgtggaagaaaaatggagcaggacactatagattccagagcaaagcctggatagagattgacatggtttggatctatgattccacccaaatcttatgttcaattgtaatccccagtgttggaggtaggcctggtgaaaggtgattggatcatgggggcagttcctcatggtttaacaccgttggccttggagctgccatcgtgattatgagttcttgtgagatctggagtgtgtggcccctgccccctccctctcttcctcctgctcctgccatgtgacacctgcctgcttccccttcgccttccttccaccatggtcccctgaggcctcccgagaagtgggacccgccgagcaccgtgcttcctgtacagcctgtggagccgtgagccaatgaaacctctttaaaaaaaaaaaaaaaaattaccagttctcattcccagaaattacacagatatgcctgtttcttttgttttgttttgtttttgttttgttttgtttttgagacagagtctcgctctgtcacctaggctggagtgcagtggtgccatcttggctcactgcaacctccgcctccagggttcaagcaattcttctgcctaagcctcccaagtagctgggattacaggtgcgtgccaccacgtctggctaatttttgtatttttagtacagatgagctttcaccatgttggccaggcttgtctcgaactcctgacctcgtgatctgcctgccccggcctccccaagtgctgggattacaggcgtgcactgcacctggccctgtttctttataccagtgtgagagtgaactaacacaaattaaggggattggcagagacaataaaagattcaacaagaaaatgttttgagccactggagggatatgatggggagggaatggtaaggtttacctggaaaaggtcgaggccgaattgtttgattggttgtgaaggctccttgtttgtcctccagctacagtcctttccacacatctcattcatacttcaaattgttccatttctcttcaagccccccaatcctcaattaatgggctttctcaaagaccaggaatatacttcagtcactaaacccagtgttctcttttcaggccttaacctacttgtccttttgtagaaatggaagataagtgtgtacctctataattaaggcagtcatgtaatgtattgtccagacagatacatttctgaatgtagaaggacattgttaataattatgttggggcagtcctggactaagcagaacgtttggtctcctgagaagcaggatcgtgccaggtgtggaggctgctccagaacaggcaagcacatagtgagaaacagtggtgccactcaaagagcatcttgagtagtagcggaataaagagcctaataattcagggacaataaactttttccattccctgcctaccccacactgccaacacctctggtccccaaggctgaatagcagatcaggcagagggtgagggagtgtggttttcaggcgtccagactaaagctgcttagtggatggaagttaaagtaccaaagacaaataacctaactctccgttctgcccagaagagccctagaactgaagatcgggaatattggttcaagtacccatacggctcctgcatgtcctacactgctgaaatggaatatacaccttggagctctataggagcagggaagagtttcgggactcaaagtatttcacccttttttagagctatgagataaatgaggagaaaacaaacaatgataacaacaagattgtaatgttaagtagctcttgatttctgagcccaagtgacaggtttagctcagtgcaagactgagctcatgaatatttttgtttactgttttcatgaagcctgcttgtggcaaagataaacacctgccttgcaaatttatttcttaaatcaaaatatatctttcatattttaaaaggaggtgtgtttaaagaggacaaggattaaaaacattcattgctggatttgtgctataatatgcttgccctaaaaattttatttttccttaatttgaccatcaagatgtttgctatgcctttccaatttgcagttttcacataccaaacttctgcagagaatctggatgttgtaaagcatttctgaagttacagaccatctgaaagtttcttaatgggtctaagagccacttcattatcttttaaaaatatatacataaactttagtctttgaaaaagtgcatttttctaaaatgctgataacgctgccatatgttgttttcatgcctttgatttgtaatagaaaatatgttcctaagaaacaatagtagattcacatgtagttgttttccttccaagccccaaattatattttctactttaccaatttataagctgttaaagccaaaagcattcttcaaaatagtctgctttgtcacatcacatacacctacctataatttataattctctatggctatcatttaaccttcaaaaagtgtcattgatattttctgggctacaaagaagttggctactctttctgttcaatgaaggaaataagaaaaataggcaaattaggtgaggtcctgaaatagactgagagaaaagaaatgcactgaatataaagtttatgactggttctgtttgattgaattttacaatgtccagagaggagaaaaatgcaaagccctattaaaaagcatgtttaaatatgttatgaatctcctgggctggttgtctcataatctggattattgaagtatagcacaggaaaggcctaagaccttaattagagtaagtgatatggcagctcgggcatcagcaacacaatctgccgattgtgagaaaaacaaaattagacaaagggctgtggtttagagacatgcttgaacagttaggattttttccctagttttttctaaagtgaaaagaagcagatagccagtgcaataagccaaggggagagggggtataggcctatttggtgggcccatatgtaagcacaacccaaggctcatatgcgctagacaaatcacagccatggagccaggaggaaaataggagtctccataaatccaattctgccagtccaagtccaaaatttatttggacaatcaaagagagaaataatgctgtgaaaagtaatcttctcttcatgtcttctatatctccatggatttcaatgattttgaattggttccccgtagaaataattgtgaagattggctgtcagccaagaaatatttttttgtgcatttactatgcataagtaaatgagttccctgtgtctccttttatcattgtggggtctccaaccctgagatctcaatcctcttcaaaatctcccacacttgtaagtacaaatgtttcaactgagctcatgagtaatttatcttagttcttctaatggccaaggcaatttctgtgcaagaaaacacaaagcatgtcatgagttcagttggcgtctgagagtggtgatgtgtctgacactcaagccaagcacggagtcccccaacactattaaactaccaactcaggccatggttcccctgatgaccggtttgtaagcaaagcgacagtgccccaaatgcactggattaaactgtgctgtgtcccttggggtcctaattacattgaagcctcttggcattccatgtgacagacaaggtcttagactctttccgccacaaaggtacttttgtgtgtaaataaatctcaattttgtctgctttgttttattgttatttgtttttgtctgtagaatctctctgtaagttttatgtacatgaagtgaggggatgtatctgagggctacatgctcaaaactatcctttgttttggagaatgatggtgtgattttgaacccgatctttgtttgccttaacctcacttcccttaggatggattaggtcacagaagatatccggatttgcatggagacgtctgtgcaggacagcccttgggcccagcgtgacttccaaccgtgattcctcaagtgattcctgcaactgtgattcctcacaagttccagcagtgctgcatgcatgtgcaggggaaaacaaggaggcatgaggcaaggatcacaccctcagaaaatgttcagtttaccagagaaggtagacacacagcaaataatgatggcacaaactgaaagcgatgtctgccacacaagtagccacgagaagaaaggacacaaatacaagcaaacactgtcaggccccctaatgtgaacacgaccatcagtttcaggtgggcacaaggaatgaaggcttagtccggtctaagatgtgggtgtctaagcgggtggttttgagggacagaacttctgtcctgtttcaccctcttcacttcctttctcctccttactgagggtcatagcctttgattgtgctccatttcactaaaaggtgcaggtacttttccttcaaaataagctcaaacccttcctgaacgctttctctttcaactcttaagcacgtgtgctgtggagtgacttgttatttcctgccctacagatctgtaagagagctagggcctttgcccaatgtgtgagaagaggtgcaacttgcttcctctcctgcattcaccttagcagggttgtcttccgcgcggctgaggtggccaagctgctcacatccctgcacccaggtcttggccactaccaaatggagaagcccagtcgacaaatgctgtggccgggcattgtcaccccagctgcgagaccttctctctatccatggggagggaatagaaggcttcatttatgccaccatatgagcaataagaactttggactggttttataagtgaatttgtaatctcacatcccaagaaaaaagtcttctgcagtttccaaacccttttaggttcacttgcttgttaattttattgtgagaagaataaataaaatcagaaatacataaataaaaatattttgatgagattgtcattcaaaatggatttgttggtgcaaaaagagtatttttaaaaagaaaaaaaatccacacaagaattatcactaatctcaaaagacataaacgtcttagtagcctgcagagatagcttttactttattttaatatcaaagcagatgaactcaaagcagatgaattaacttccttaaaatatcaaaagctgattgtctgttctcataattcaataaatttggcaaagaaaaagtgtttcaggtaacacatgctttatgaaagtgtctcagttttgtaaattaccccttagcctccagtattagagaagagcttcagatttttataaatattaatcctgtcctggtttattacgtgctgattcagatataaattacttttaaaatttaaaaaatgtcatgcttattggcctaagaaaataatgactttcctatcagagactacaaccagactttaagaactcaatatcataaaaatgtccattctccccaaatttatttacagattcagtgcaattccaataaaaagcccaaaagtttttctatgtaattagacaagttgacttttaatttatatggaaaagtaaagggccaagcacagtggggattcatcattgggtgtatcaaaccttattgtaaaccagaagtaattcagacagtgcaagtgttgtctagaaatagacaaataggccaaggaaacaaaatagaaactccagaaataaactcacatatacggaaatgtattaagtgcaaaagcagggatcgaagctctgtggtgaaaggaagggctgtttatgaatggtacttgcacattaacttatggataccaaataatggaaattggattcctacttcacagcctatacaagtatggtcatgcactcccacataatattttgatcaacagtggactgcatatacaatggtggtcccataaggtaatcagggagctaaaatatttctatggcctagtgatgtagcagccgtcataacatagtcacataatgcattaccttttccatgtttagctgtgtttgatacacatagaatcatgttacagttgctgacagtactgagtacagtaacctgctgtacaggtttgtagcctaggagcaataggctattccgtatagtgtaggtatgtggtaggttgtgccatctagatttgtggaagtacactctgtgatatttgcacaatgatgaagttgcctgatgaagcacttctcagaacgtatccccattgtgtttctcagaatgcatcctcgtcatcaagtgatgcataactgcatagctttaaggtagatttaggacttaaatatttaaggcaaaactacaatctttcaaaagacagtatcagaaatatcttaattacctcagggtaggactttgctttaaaaagatgtaaaagaactaaccataaaaaagatggataattcgactacattaaaatacagagcttctgatcatcaaaagaaactattagaaagtgattggacaagtctgaagtaggaagaatgtctgaacaacacagaagcagcaaaggcttggtttgaagagcataaaaacgcttataaatgaattttaaaatgataagcgatgtgataattggcaaaagctataaatagaaatttctcaaaataagcagcataattgatgcatgagatatgaaaaatacccaatcttactagtaatcaaagaaatgcaaattaaaactacaataagacagcatttcctatccacctcagataacgttcttaaatagcagagcacatatatatgatttcactttttgtggtttagcttttcattctgagaatgagaataaaccttttcacccatgttttccatagtccggtctgttattctacattcttttacattctaataccttatgttttccattacatcctttcttctcacccttatatcagtttctaatggatttagcaggaaaccaacattcctgttcaacttgtacaaacttgtgaaaacataattgaaatgaaaatggaaatttcaggccaccagatgtctttatgcatctgcataaataacagtgccatgaaattgaccccagcctaccttttaagtaggaaaacactctcctttaatccaatgtggatgattatggatgattcatttgctactaatttgctgaaaactcaattcagaaaatactaacaatacgtatattaagccttaacaaatgacattcaacagaaatctgtttcctttgatacttttcctttaaggaagtctccagacagtgtttcctaatcagtataatgagctttctggaatttatgaaagcgaaggctcctttcagatctaaagtttcagctctgtattttcactattaagaattgtttacacctataaaaccagattgaagagctttgctaagtctccgtccctcttctccatcccctctgcatccgtgtctcccaaagctctttattaccctccccatttctttgctctgtttctggctgccgcttttcctcaatcttgctctcattctccttcacactttactgctctctcactaactccacaagtttaaaaaactaacccaacttagaaatgtctactaacttcctaaaacatcctccacaacattaaaaagcactgctaatatttttacaatacaatacacaaatatttaataaaatcaggacaacacacattcccactttgtaccatcgtgttaccaaatgagattcacttgtaatgaacaaatcatcaatcttcgctgttatcagaaactagcttccccaagccttccagtaattttttagagttctggaagcaatagctccaaacctagtctgtcagcaggagactcggcctggcttacgctccacttggacttctgctcgggctcccgggaagccatctggggcagcctggcgtccatctgcccttctgaagtaggtcgcagaccctgccaagatactgaccctggatgccagtgaaacctcatccctgtcatgacaaagaatctctggagtccaggtaaaggtagggagaatgcctcctctccaacatctcccacactgcatcgtctggacaatggcacagttctacttctgtgggcacctctgttcttcatgaaaaacaccactgccatattttggccagatctgggcaatacaaggctcactctcagcccaaagggcatgcatgaaacagatttcttcccacgagggagagaccctcctattatcctcctaaattccatccccacttagaaccatcctcccatgtatcctcctataatcaatctcccatgttatttatctcctaaagtctattcccagcttagaactgagaattcttcctttctcccagttcccacacttgcctagttaaaaactgtccagtttaaaacaacgacttccatgcatgccaaagacagaagcagatcttagaagaagatggcttcccaaccccacctttctcagggctcttgctaaataatttattagattgaccagccagacctggaatttgaacctgacgcatgatcttggtggagatactaactgctcatttatcatccctaaaagggagaaaaacctgcatttgccatacttcaagatctagtccacacttagcttccctttggactgctgcctttcactctttcatttatctagaatgctgtgtattttcctgactacatataactacaccgtaaaacatctgaagactgcataaaaacataagaaaaaataaataaatcatttcaaaatttcatcacactgaggcaaccactgtcaagatcttggtatctgtttctgttatgaaaatatgcaaacataaattaattttacataaaaggaatcatttctgtttacatcttttaaatttttactgttgcccttttcttgctttccccactccacaagtgtccttattaatttctttattcctcatatcattccttgaaagttgtttattacaggtatattttcctttttctctttctggctgcagaattgtgttaagaatgagataaaaattacccatgtacccatgaccttattaaaaatcatccatcaccgaaacagctgatattcctcctagttcttccccaactgcctccttctgcacccacattagccagcatcttcctttggtgtttgtcattctcacggatacctttacatgtgtgtcacatacgtctttggcactaaacagtatgtagcactgcgttatatgttcctaaccgcagtacaaatggccacagctatatatattttcctggaatctctcttttctcacttaatgcggattaatatgagtaagtctagtttcttgactttgctattttgccacattctcttgtgggaatgtacatcaaggtattagtcaattcctctgttaatggacattgctgttgttttcatccttttgctctcctgtggtctgtggctgtgagcctttttttcagattgaggcagcatagcaagcagttttgaagggggactccagtgcagactgcatgcatctgatgtgtggtggcgccatgtaggagctcagcagccttggcaagttagttaatccactgtgcgtcacttccccattttaaaattgagataaaaatagtatgtacttcataggactattgagaagagtattaacttgaagcatatgcaattataattttcatagtccaaaaatggtcacatattagcatttttatatggtgaaacctaataaatgagataattgatatagcatatttagaatggaggtatacagtcagtacttagtattagctgtaatgatagcagtggtgatgacaatgatggtgtctctttgtatatgttaagtctcaggctttctctggcctaaacagccaggaatagaattgctgggtcacaggatctatccaaattcaacctttacctccagaatgttctccagagttttctatccaagatatgttttatttttctacatatttgtgtcttaatatttttcaataacgttttataatattgttcataagaattattcgttttcttctctctttcccctctcctcctctctcttcttctgttcttttttatctctttcttcctcctcctctacctctccttctttttcttttttctcccaaattcgaagatgaacactcttctgctatcagagtagaaaggtctgtgacttcctcatgtttctagaagatctccatggatcatgcaaaaggtcagatgccatctttactttcacagctctggaaatccatttgctaagctctcaattatcacccagagctctaggacggtatttctaagacttttgtgtggctcacagagtatcatgctgttaactgtcccagaagcctagaggatcccttggctttacagcgcacagctcctgaccctgcagctccactggaaattggactgagccatcatcttccctgagcctccccgcttcgctcttcattgtcctccctccctattcggcagatccagagattcactctgctgcgtaaattcttttagtcccaagataaagcactgcctatgaagagatgtctaacttttaaaactggccaattacatcaaaatttatttggttctataagcaaagatatggcccagcaatttattaacaggaagggaatgctaagtgaatatcagcaatcattaataaagatgttgtgaatggtttcagaacgcacagtaaacaatttaattccaaatgatatattaagagagaactaagaagaggatttctttcagatagcacagaatagaatatttttccaaattaatagttacaatattcaggagaaacaaaccgttcaaaataactgaaccctgcctgtagtctctttcctgtattgctaatcctctttcctatttcgtttttctgtcatttctttctctctctacttggctttttccatcagcatgtaaatctaatttagtttttgccatccttaataaaaacaaaatgatgcctgcgactgttgtctaatgtctacttttcaaaaccaaaattttcaaaagcactatttatgctgtttgtctcttcctcttcccctttcctcccagcccatttcaataaggctgactaccgccaaccactccgccccagaggcatctgcccccggccgcgcaccctctctccctcaccacgccttggtgtcctcacgttcccgcacctctcagaagcgcttcctccacgctccacaacggccttccccgcccagaagcgcttcctccacgctccacggcggccttacctgctcagaagttcatgctcccagcggccttccccacccagaagcgcttcctccaggctgcgcaacggccttccccgcccggaagcgcttcctccagtctccacagcggccttcccgcccgggagcgcttcctccacgctccacagcggccttccttgtgagaggtgacagcgtgctggcagtcctcacagccctcgctcgctctcggcgccccctctgcctgggctcccactttgggggcacttgaggagcccttcagcccaccgctgcactgtgggagcccctttctgggctggccaaggaggagcccgctccctcagcttgcagggaggtgtggagggagaggcgggagcggaaactggggctgcgcgcggcgcttgcgggccagctggagttccgggtgggcgtgggcttggcgggcactgcactcggagcagccggccggccctgtcggccccgggcaatgaggggcttagcacccgggccagcggctgcggagggtgtactgggtcccccagcagtgccagcccgccagcgctgcgcttgatttctcgccgggccttagctgccttcccgccgggcagggctcgggacctgcagcccgccatgcctgagcctcccacccgcttcacgggctcctgtgccgcccgagcctctcggatgagcgccgccccctgctccatggcgcccagtgccatcgaccacccaagggctgaggagtgcgggctcccggcgcgggactggcaggcagctgcacctgcagcccctgtgcgggatccactgggtgaagccagctgggctcctgagtctggtggggacctggagaacctttatgcctagctcagtgattgtaaatacgccaattgatactctgtatctaccgcaaggtttgtaaacacaccagtcatcaccctgtgtctagctcagggtttgtgaatgcaccaatcaacactctgtatctagctactctggtggggccttggagaacctttgtgtggagactctatctagctaatctggtggggacgtggagaacctttgtatctagcgcagggattgtaaacgcaccaatcagcgccgtcaaaacagaccattcggctctaccaatcagcaggatgtgggtggggccagataagagaataaaagcaggctgcggagccagcagtggcaacccgctggggtccccttccacagtgtggaagctttgttctttcattctttgcaataaatcttgctgctgctcactctttgagtccaccctgcttttatgagctgtaacactcaccgcgaaggtctgcagcttcactcctgagccagcgagaccacgaacccaccagaaggaagaaactctgaacacatccgaacatcagaaggaacaaactccagacgcgccaccttaagagctgtaacactcaccgcgagggtccgcggtccctcttcattcttgaagtcagtgagaccaagaacccacgaattctggacacacctgctcagcagttcatgctcccagcggccttacccgctcagaagcgcttccgaagtgcttcctccaggctccacagcggccttccccgctcgctcctttgagctcctcctcggtcgcttttgccagcctctgcctccctttctagcgtcctatttcagcacactcattttcgtttcaggcaggtgcgctttccgttcccagagcgcactggaacctctttcccgctggcctcagccttttcttggaatgccctttccagccttttcacgtggaagcaccactcagcttcaaagccacctccttgggaggccttctctgaccgcccagcctcgttcgcgccacgtgtacattctcagtgcagccagtaaccgcccatttatgtatacatacacatgtaaatgcacatataaataattcacccactataattttgatgaaatatatatttaagaatgtgttgttttgtccatcattaaagtccaagctccacaaaatcagaaactataacttttttattcactgccacatctccagaattagcagattgttggtatagtgttaattgaataattggataaaatttccaacatacaagccctacagaaaagaacatgtgtggtggaaactaaaatacattttgcctatttacagaaggagatcagttggaagctttccttggactaagagcatccttagctatgaaggcgaatggatcttgaggctgcaaggtattcaacaaatattggtatgatggggtcatattgttgacttttaaaaatactgcaatatactgacatatcgaaacagcgacgttcggctatgttttctggtgagtatgccttcaggaagaagaaaagacgagatgccttcccattcgaatggtttatgctctgaatcacaaaagtttataagatcaaagtgaaaagtcaatgtagattttgtagaatatttaatgaaacgttttgcgtgttagggctccaggtagtgcacgatctttcatggcaggaaagccccactccgccaccatgggaatctgtgaggacgccaagcttcagttctagatccagaagctttcccagggagcaggctgccgtgccatttcacattccacgtggcatttccaatggggatgatgagaagccactgagataactctttggagaaacattcagctctaggaaagtactatgtaacctgataggttcacttttgacatttcattttatatatttctaagaattttttaaaattcctgcatgcagccgttagacaaggatcataatcctcattgatgctgtttaatgcctaataacagatgcatattggctctagtaaatggcttgtaaggtattaacattaattctaggtataatataataatacaatcataaaacaagtaggaaatgacaaagatgagaacggtgaaaacagcatacaatcttcaaggaaaagttatacatatggatttaaaccacaggtatacagtcatttttattcatttttgtatacctataccactaatataaatgtcagaagcaccacattctgaattattattagtgttgtttttgtctccttttggcctgaagaatttgaaagccactattttttactctgcttcaaagcacgggcctcatggtgggtatgctgttttaattgaggcgaggtggttcctgtaataagtcatggttcttctgcactgtgggttagactcacagtttataaggctgagaaaagtgcagtggagtcaaattctacagtttcccagcagcagaacacgtctaaaaatactcagaatatcaggtagttctctcccttcctctacttttttaaaaaaactctttcttcctcccttcctctcatctttcattcctgcctttctccctcccttcctcctttccttccttcctttttctatcatatcgtatcatatctatcatctatctacctatctaatctatcgtctatccatcacctttcttcctctgtctcttccaccgctatcttcctaaaatagtttctatttttattactccgcaccagcactgtctcatagaactttctatgaggtcagtggcatttcatacctgcactatccctacagttggcagtagccacacttgagctattgagacatttgaagctgtttgtcactttaaatgcggctagtgcaactgagaaaatgaattttaactacttaattttaattaatctaaatttaaatagccaatatggctagcggctaggatacacttacgaagaaaatgctgccctgaccttcgggatatcacattccagggcacttgtactgacaacattctgcacagtatattttgaggtttattgaatcggtgggcgtaacattcctcatcacatatgagcttaacaaaccaacaatacagcagaacgtcaagctatataaaacaaatttatataagcaaaaattgattacgagactcaagacagcaagacaattcattgtcaacaaacatgttaaacaattccacaaaataagtaggtttttgatcaagtaatttgtcttcccaatattttatattctcctacaaatcattttgttctcagagctgcaacctgtgttctaggctgggtccctctttgacatatctcgctatgtgatattagacaactcaaattgttctctaagagccataatctttccacctgtaaaacaaagactaaggccagtgatctacaagcactcttactgctgtcagattctggaaataaagctcttagagaattttttttcccacaacatctttaacacatagttaggttgtcttttaaatattaatctagagatgtggaaaaaatacttataccacctctatgtgttagtctttgcagtagtattttgttggtttatgtgtgtgtgtgtgatggagtcttgctctgtcacccaggcttgagtgcaggggtgcgatctcggctcactgcaacctctgcctcccgggttcaagcgattctcctgcctcagcctcccaaatagctggtattacaggcacataccaccacgcccagctaactttttgtatttttagtagagacagggtttcaccgtattagccaggatggtctcgatctcctgaccttgtgatccgcccgcctcggctttccaaagtgctgggattacaggtgtgagccactgcgccaggcctgcagtagttttaatatagctgctagatacaatcttagattgttgaaacacacacacacacacacacacacacacagggaaagagaaggagtgctaaactgaagctataattttttttttattttattctactcttttttctttttttttcttggaagggagtcttcaagtaaaactatgtgtgttgatagagcatagtctttttctcatcacatagctaaaatgcccttaagaagtatgggattgctctgcccttactggtttatggaagctcggtttacagctccatctaaaaagatggcctttcgagaatatgctgttatgggtgttttctagggaagagtatcttttaagaatgtgtgtgcacgtgtgtgtttgtgtgtatgtgtgtgttagactagatctatcttgcccccttcaaaaatgtttcataaatatttaggaggggaggtcttgtgtgttggctggaccacagttgtttagaaaactctgccatatgtttgcttaataatgcaagcctgtggcttttagagtttgggtatcccatggattgttttgtaaaataattttaatttcaaatgattatagtatttaatttccctttcatcagccattaaatacctcaaggagttattatttattttctacctactttcagtaaggattcggggtgggttttgaacacattcagtaactgcaatagtcactcttgtagaggaagagtctcattcgattgttcctgcatggaaaagatgttcagtcaattctctattatccgcactaatagatgggtgcaatcaagcagataatttaagttatcgagagcagcacaatccagtttgtattttactttagaacatgtaggtatgataggtgtttagccattcaatctaaatggcaaaagcaaacatctgaaaagcccttcggaggcacagaaggaagcccgctgtctcctctcaggatcctaccccctgtcccagattcaccactgaaaatggaatgcatcaccgatgacaaaatgagagcctagtgtggaattttcttacctgagtttctggctgagacccttcctgggagagatgcaattaggtgttcaagtttagatcattcctcttccagttaccgcaggaagagacaggtttaatttcttatggcagatgagaatgctggtaagattccacccgtgcaccactttgcaaggcagttgaagaatccctatgccgtagttagtttccacttgttaaatacttctgtcactgtttcacaatgccaaagctttgcttgctgtcttagccaactgtaatagggtaaccactgcagtagaaatttcacaaactgtacccggtctcattgctagtgcattaaagcaattcatacataacaaaatatgacaggataaaatgaaataaaataaaaagtctcctgaaaatcagtattgtgcttatccttccacaaaacacatatcagatgggtatgaccgaggaactactggattcttcagtcagtatccactaataattactatatgttcattatgaaattgagagtaatgcacaggagagagacatatttcatgttcactaaaagcacaggtataaataagtgataatacaaaagaagacctactttacaatgtacattcaatatattacatttctcttcattgagatccagactgaaatggggaggaggttgacatctaagtcatttatagaattttgagtgtttcccaaagttcttaggtctaatcagagagactctgctataatacaatccatgggaaatgatactggtttcattttcaactggaaaacttattctatatgaacagagaggatgagtaacagactaattaatgacatctgaaaagagtaacacatggtttataatcagctgatgtactgttgagcattttagttttgaccttggcaagatttggttctaagactatctgtgaaaattttgatttcaattctgtataactactagactgcacacaaatctgattcagaagaaagttaatcattaaaatgttagattccttctaagtagtattgtttaaagcatttaaatttagtttctggggttttctcattaccaaatataatggaaagattgtatatagcaaagacttttcccagtgttctgtaaatgtagtaaagatgtttaaattataaaaatgcagctagaataaatccatattcattgtaaatatctcattgtatgatagttatatttgtgtcttctttgccaaatgtatgtatatttttattctgactcattactgacctttcatcaatatttgttaattaaacaaaattattactacatatggtagaatgcaagctgaacaggaactcgaagagtgcagcaaacaatgaagttttgaagggggaggtgaagactgtgacaatgagctgcgcattgaaaggcaaatagggaatgaaaaggagaaattataaaatttagttttaaaaactttttctttttacttccaggaaactgtttaaatacatttctacaggaatatagactcaaaagactatttaactggatacataattttcagtaaattaataggcatttgaatcctaaaaagaaaaaacacagtaatagcattttgatgaatggagatgagttgagtaaaggagaacatatttttgacatatcctcagaggaggcgtagagaaatacactaacttccaactgaataggaacaaattcctgttcagaatattatgaggccaattcctgcctaccagtcaatcccctcaaaattcagaagagaaggaagaaataaatttatatttatatatcacatatatatatatatatatatatatatatatatatatatatatatatatacacacacacacacacacatatttcattcaattgaacaatattaattttaggttattttatacccgtttcaagactcagacaagttaaataacatgcccaacatgacgtagtaaatagtggatctgaaattcaagcccagaaatttaaatgcaaagtcaagccctttctgctacaatattcaatgttagaagaaacgatagagtgtcataattattaaaaataattatgctttctgtaaaactaattaatgttattatctttaataagtagcttcaaagtaagataaatcaattgtggaattaattagataaaattcagaaaaaagattgaaataatgtctggatattaattttaaatgtcataatttcaattatatttaaatttctttttattaatatatttattaaatatgtattaatgtaccctatgtgccacacactgtgttgagaacagagtattcaattgtgaatgacactgttcttgcccttgagaaattcatcatgtcgcccttttgtattttcagattttgcccaatgggaaatttgttgctatggggatcagcacatgacaaatattagcagatttatgagtgtagtgtgattctgaagtaagaggatatctccacaagcctcacagggatatttatctcattattttataatcacacaggtgcctaatgatttattttaatttgtttctatgaataggcactgtcataaacccttccctatgtgcacctcatttttgttttgttttttttttttttttttgagtcggagtctcgctgttgttggccggggctggagtgcaatggtgcgatcttggctcattgcaacttccgcctcccgggttccagcaattctcctgcctcagcctcccgtgtagctgcaattttaggcacgtgccgccacacccggctaatttttgtactttttagtagagacagggtttcaccaccttggctaggctagtctcaaactcctggcctcaggtgatccacctgcctcggcctcccaaagtgctggaattacaggtgtgagccaccgcgcccggcctcacctcacttttttcccatttttttaacgactcaggctccacacgtcactcactttttgggctcctgcttggttttgtgaaacaattttcagtctgtgtcctgaggtcaattctactctccctttcaaacatgatgcattcttttgcaaactctcatcagcattaagaactccttacaagtaggcacaaagttctacgactggcaataaatataagatcaactatgattgggtgcatatacatggacagaaaagggcattctatcataagcatattttaattaagaaatattttaacttgattgaaaaagtactgttctttttattatctgtgagcctatgatgcattatgagattttatactaatgttggttattattattaaaataaattcctatctgtagtggctgatctttttattttaattgcaaaatatagaaactgaagaaagcgagaacgacgagggaacccactatcccatattggacaagaacaacacctttctggaagagattttttttggctagggaatgtctttttttttttttttttttttttgagacagagtctcgctctgtcgcccaggctggagtgcaatggtgcaatctcagctcactacaacaaaccgcctcctgggtttaagcgattttcctgcctcagcctcctgagtagctgtgattacaggcgcatgccaccatgtctggctaatttttgtatttttagtggagacggggtttcaccatgttggtcaggctggtctagaacttggctagggaatgtcttattacatttacaaacattcctctgaagctgcatccaaaagagcactgcagacgaagagatgcccatgtagttcatgtatttcaactcatcaaggcaattctgttggttctttgggccacctgtttctagagccttcttccattttgaccatctgctctaacatgcatacaatgtagtgcttagggaccaagcagtgagaaactgtttgtttaacacaaatccatccatatgattggaaaagtactctgtgcatatttccattaagtttcagctttttttccaactataataaagagctctttgttatcatcacacaaatgtctaatgccataaagtatagcttaaaattttgcaaatacattccaccatttaatattttcccatgaatctttaataatgagataaagttataaaatatagacacataaaaagcaaacattttcttttagttcctcaggtatttcaacctttcttatgcatttatacaatgctctctttctctggcctgttacacaaaatccacatgtgcaaacacatagacacacagcatgctgcagcctcaaccctggtttctttccagcttactgtttacttcggcaggcattagctgcctctacagcagaagaccttcacgtttttttcactcgtgttgtattttattggagctatcaaattgcagaccattttctacctatccctgattccaacaagaaaagaaaaaatctgaattatgtgaataatggagatagctttgataaaaaaaattaccttcaatgaagtataataacttaaacttttttaccaaatatcacaaattatgtattcgcaatagagacgtatggataagctattatgacattaataagtgatcagttcccagaatttggaagactctcatggaccccagtgaacccacagaccactgcattaggaaagtcactactagtagttgtttcctgtgaatttctcagtttttccctttgtctttgaccaaaatcttcagttccattcttccatcaaaacttttcatgaaatatttctaacaaaaatacacaaattaaattttatattccaataatacactcaaattttagatattgagaaactaataagaagtgattgcaggggggttgggaaaatagaattgatttgtaaatgaatatattttatttcatgaatagccatactacctctaatgtagacagcaatagctataaaatgattccttttattttctatttaacagaggctcttacattctcatttcctaatattaatctcctccattatataaatttattttcactggtccttaagtcctgtattcttttaagataaatggtacctttagtaatctatctggttccttcttaggtattcaatattttatactaaaacattgctaaatgtatgagatgggagttccatgaataatgagatggggagacaagaaatgaccagtgttaacaaaaaatattcaattattgaattttttgatataaaaatatgaaaaacaaggtaaataattaaaatttagtaacagacatgtgagatctctttgaaagaactgagattacagtatctggtgagaaaatggttgatcttgaacttgaatagacaatgagctatgatttgaaattatagttcttttttcttcaaaataatgggaaaaaggaaatgggaattatgtgttaagaaatgttttcagatagcaagtgaatagaagctgtcattccacatgagtgcattgttcaggaatctgttgcatataatgataaataaaactcaaactgtcttaaataatgaagacatatcactggcttggaagatgtctgcaaagccttgatcaagtggcgcaatattactgaagacagatttcttccatctctgtcttctacagtattttgcttcaatccaaaactggctttagctttcatctaaagctctgtttctggtcacaagacggaggccagtcgttagcaggagagccatgcttctaatcacactcagtaggaagaaaggttgtttcttccagtacgcttcttggaaaaacaatccaacttctattggggaagtccacagaaaatgtcgctacaatttgcattggccaaaactgttttacgtttccaggggtggaggcgagggttggggcagcggtcagtttccatgaagtacaggtgtttcatggacaaggggtatcatgcaactggggcttaattaacaggatgtaagaggaagggatcttgggcaatcccatttggcaaatatctaccagtgagaggctatttgatgagattcatcctgggttttgctgccagccctgtaaactcatctggggaaaactccattgctgagattactcagtacaagttgcctaccttaagttgagaaagaatggtaaatgtatctataatacttacaatcaaagggtccaacatctttaaagctaagttcattatcttcttgtttctttctttttctcctcattcaacccttgccctcagacacctatgcataattggagcagaaacaaaaaatagagcaataacatggcatgacatttctgaatccacacaattctttcggtattgttttaatacttttcatatatatatatatatatacacacatatatatatgaaaagaataaaaatatatagaaatatactttatatatttttattcttttcagaggtgatacataaaggaatttgagaagcatataaaaattaggttggttgattgtggcaaaatggctttgagcatttgtttattttacatttactaaatagggtatatgttttatgattttcttatgatgcagtgacaaacaatgctgaatagaagtcttcaaagggagcttaattgctttcacctttccgtgattctatttgcaaaccccttcatcattgtactaaaaaacatttatgttttctggtaactgtctcaaacccttcccgttttcaaagaatctctatggggttaaaagaactagatattccttcttcttggcatcaagggaatcagcagaactgacatcaactaggctctggcagtgcaggtttctacttcagacttttgaatattaacatggggatttaaatataagatagctaatacgtatgtacttctgattatgttgcagactatgttctaaatggtctcatttaattcttaccacaactttatgtaatagagacttctattttccacatttttaagatgcagaaactgaagtccaaagatgaaagaccagttaatacagtattagtaatggcaataagctttgaaaatctcctgagaaaaagggaagcatgacccaagatccaggaagtgcatttccacgtccaaccatgctggagtaactctctacaagcaactctaaaactaaactctaaaagcatatatggataaatggttttctggcattggacaataggatcacatgctttatgcgatttctgagagaacggggctctaggagatgagatgcgtggctgccccactctcagcctggaatgatttcctaaccaaaacacaaggagttgaagtccaggcagagaactatggtctcattgggatgagaagtggagatcagaatctgaggctgctgaaggggctgctatctgcagggcaacggaccgaggagattcaatactgacgtgatgtctgttctccaaaaatctatacactcaatgcaattcgaatcaaaattccaactgactttttaaaaattggcaaattgcttctaaatgttgtatgaaatcaaatgacctagaaaattcagcaattctgaaaaaaaagaagtaactacaaagttggaagatttaacctacttgacttcaaaatttattgtagggctgcagtaaacaaaatacttaatgttgcataggatcaattaaatacaccagagtccaaagtgtgcccacacatatgggcaattgatttttttataaaagcaccaaagtaatttaataagggggaaatggtctattttcaacaaatagtgatagaatagttagacatctgtatgattacgaacaaaaatgaaccctgaatagggtagcatgctccctcacactaacacagtaattaatttcaaatagatcatagaattcaatgtaaatgccaaaacaagaaagctttagaaaggaaacacagaggaaaaacgtctttgaccttgatataggtaaagatttcttagagaatacttaaaaagcatgaaacacttttaaaatgatgaaatagactttaaattaattctgctcttaaaaatactatgaagaaaatgaaaaatccagctggactggaaaatatctgtaaatatgtatctgacaaagtgctgatgtccagaatataaagagaatttttacaactcaatggtgaaataaataacccaattacaaaattgtcaaagggcttaaaatagatgcaacaaaacagaagataaagatcaataaacacatgaaaatatcctcaatatcctaatttaccagtaaaatacaaattataataaaatgacatactacttacccactggaaaggataaacttaaaaactgacaatatgaaatattggtaagaatatggagtacctggagctgtcatacactgcaagtgaaatgatgaaatgatgtaacacctgaaaactgcttgttagtttcctgtaaagttaaacagatacttacaacattgtacagcaattcaacttctgtatattacctaagagaaaaaatatatacatatgtccatacaaaggcctatacaagaatgttgacagcagcattattcttaatggcctgaaagtggaaaccagtgcaaatgtccatcaactgatggatgcataaacaaattatgcaatatttatatgatagaatactattcagcactaaagaacaaccaactgagatgctcaacaacactgatcaatctcaaaatgtaatgctaagtgaaaaacagcgaaacacaaagactccgttagtgtatctttccattcataagtcattctaaataggcaaagttaatctgaagtgatagaactagatcagtagttgccaggagtgggagactagggattgtaaagggagtgttctgggggatgaaaatgttttgtgtcttgaccatgatggtagttatggaggtacacatggttatcaaaacttgtcaaactatacattaaaattgtgtatattagtctatgtaaattagacagcaagaaagctaaatttttacaaatatcaggactaaccctggagtcttgcatccattggcaagaatatcaagcatcctatgggaaccattgtaaccacaattttccaatggcttgatcttggctgagtttgcaactcctttggttcttgtcctgctttagagcctgaattcccaggcttcactttgtttctgtaagctcgccaatgctttcactttattattatttgcttaagttggtcagggtgagtatctgttgactgcctactagtaggcctatctccagatatataggagcagagtgacataggctcttgatatggaaaattacagtctgctttttaaacacctaactcttaacagtaatgtgttgtttgatcttcaacaaattttttccctactatgtgatgcagtctcctaatttggtaagcatgcctaatttcccatgcaagtcttcattagtacaatgtcctctgcatgttgattgactgaaagctttatcccttataaaggcccaactgtatgagtaataagtgaccagtgaaaaaataagttggtaatttacagtattttcattccaacttatcctactttccttatggaatgaaaataaactgtatgtatatatgcaccatttgaaaacatcttgttttgttcatcaatgttataggaagtcacaatttagactttaaaaacataattgaaatactgatttacaaggtaaaattatgtaagaaatatcactgagcatctccttagtttcaaattaaatgggatctagttaatacttttctttctttggagacacatgttctacatcttaaatgtttttgaatgttcattacttaattcaacaagtaaaaaaacaaataaaccaattaaaaagtaggcaaaggacatgaatggatacttctaaaaagaagaatacaagtgaccaacaaacatgaaaaaatgatcaacatcactaatcatcacagaaatgcaaatcaaaacaacaatgagattccatcttacaacggtcacaacagttatcattaaaaagttaaaaaactctctagattcctcctctctggacagggcatctctgaaagaaaggcagcagccccagtcaggggcctatagataaaactcccatctccccgagacagagcacctctgggaaggggcggctgtgggtgcagcttcagcagacttaaacgttcctggcagccagctctgaagagagcagcagatctcccagcacagtgcttgacctctgctaagggacagactgcctcctcaagtgggtccctgacccctgtgcctcctaactgggagacacctcccagcaggggtcgacagacgcctcatacaggagagctccagctggaatctggtgggtgcccctctgggatgaagcttccagaggaaggaataggcagcaatctttgcgttctgcagcctccactggtgatacccaggcaaacagggtctggagtggacctccagcaaactccagaagacctgcagcagaggggcctgactgttagaagaaaaactaacaaagagaaaggaaaagcatcaacatcaacaaaaaggacatccacacagaaactccatccgaaggtcaccaacatcaaagaccaaaggtagataaatccacaaagatgaggaaaaaccagcgcaaaacagctcaaaatcccaaaaatcagattgcctcttctcttccaaagtatcataactcctcaccagcaatggaacaaagctggacagagaatgattttgacaaactgacagaagtaggcttcagaaggtggctaataacaaactcctccaagctaaaggagcgtgttctaacccaatgcaaggaagctaagaaccttgaaaaagggttaaacaaattgctaactagaataaccagtttagagaagagcataaatgacctgatggagctgaaaaacacagcatgagaatttcgtgaagcatacacaagtatcaatagctgaatcgatcaagcattagaaaggatatcagaaattgaagatcaacttaatcaaataaagtgtgatgacaacattagagaaaaaagaatgaaaaggaatgaacaaagcctccaagaaataagggactatgtgaaaagaccaaacctacgtttgattggtgtacctgaaggtgacagggagaatggaaccaagttggaaaacactctcttcaggatattatccaggagaacttccccagcctagcaaaacaggccaatgttcaaattcaggaaatacggagaacaccacaaagatactcctccagaagagcaaccccaagacacataatcatcagattcaccaaggttgaaatgaaggcaaaagtgttaagggtagccagagagaaaggttggattaccgacaaagggaagcccatcagactaatagcagatctctctgcagaaaccctacaagccagaagacagtgggggccaatattcaacattgttaaagaaacgaattttcaacccagattttcatatccagccaaactaagcttcgtaagtgaaggagaaataaaatcctatacagacaaacaaatgctgagagactttgttaccaccaggcctgtcttacaagagctcatgaaggaagcactaaatatgggaaggaaaaaccggtaccagccactgcaaaaacataccaaattgtaaagaccattgacattatgaagaaacggcatcaactaatgggaaaaataaccagctagcatcataatgacaggaacaaattcacacataacaatattaatcttaaatgtaaatgggctaaatatcccaattaaaggacacagactggcaaattggataaagagtcaagacccatcagtgtgctgtattcaggagacccatctcacgtgcagagacacacataagctcaaaataaagagatggaggaatattcaccaagcaaatggaaagcaaaaaaaagcagggattgcaatcctagtctctgataaaagattacaaaaggtatcaacgcacaagaagagctaactatcctaaatacatatgcacccaatacaggagcacccagattcataaaacaagttcttagagacctacaaacagacttagactcccacacaataatagtgggagactttaacaccctactgtcaatattagacagatcaacgagagagaaaattaacaaggatattcaggacttgaacttagctctggacaaagcagacctaatagacatctacagaactctccaccccaaatcaacagaataaaacattcttctcagcaccatattgcacttattctaaaattgaccacacaattggaagtaaagcactcctcagcaaatgcaaaaaaaaaaaatggaaatcataacaatctctcagaacacagtgcaatcaaattagaactcaggattaaaaagctcacccaaaactgcacaactacatggaaactgaacaacctgcccctgaatgactactgggtacataacaaaattaaggcagaaataaattagctctttgaaaccaatgagaacaaagacacaatgcacaagaatctttgggagacagctaaagcagtgtttagagggaaatttagagcactaaatgcccacaggagaaagcagcaaaaatcgaaaatcaacaccctaacatcacaattaaaataactagaggccaggcacggtggttcacgtctgtaatcctagcactttgggaggccgaggcaggcggatcatctgaggtgaggagttcaagaccaccctggccaacatggtgaaaccctgtctctactaaaatacaaaaattacccaggcatgatggtgggtgcctgaaatcccagctacttgggaggctgagatgggagaatcacttgaacctgggagatggtggttgtggtgagcttagatcgcaccactgcactccagcctggacggctgagactttttgagtgcaactcaaaaaataaaataaaataaaataaaataactagagaagtgagagcaaacaattcaaaacctagcagaagacaagaaataattaagatgagggaagaactgaaggagatagagacacaaaaagccttcaaaaaatcaatgaatctaggagttggttttttgaaaagattaacaaaatagatagaccactaggcagactaataaagaagtaaagagagaagaatcaaatagacacaataaaaaaatgataaaggaggtatcaccactgatcccacagaaatccaagctataagagcatactataaacacctctatgcaaattaactagagaatgtagaagaaatggataaattcctggacacatacaccctcccaacactaaaccaggaaggagtcaaatctctgaatagatcaataacaggttctgaaattgaggcagtaattaatagcctaccaaccaaaaaaaaacccaggaccagaaggattcacagccaaattctaccagaggtacaaagaggagccggtaccataccttctgaaactattccaaacaataaaaaagagggaatcctccctaactcattttatgagaccagcgtcatcctgatactgccaaaatccggcagagacacagaaaaaaagaaaatttcaggccaatatccctgatgaacatcagtgcaaaaatcctcaataaaatactggcaaaccaaatccagcagcacatcaaaaagtttatccaccactatcaagttggcttcatccctgggatgcaaggctggttcaacatatgcaaatcaataaacataatccatcacataaactgaaccaatgagaaaaaccacatgattatctcaatagatgcagaaaaggccttcgacaaaattcaacacacctttgtgctaaaaactctcaataaactaggtattgatggaatgtatttcaaaataataagagctctttatgacaaacccacagccaatatcatactgaataagcaaaagctggaagcattcctttgaaaaccggcacaagacaaggacgccctctctcaccactcctattcaacatagtattggaagttctggccagggcaatcaggcaagagaaagaaataaagtgtattcaaataggaagaaaggaagtcaaattgtctctatttgcagatgatatgattgtatatttagaaaacctcattgtctgagcccaaaatctccttaagctgataagcaacttcagcaaagtctcaggatacaaaatcaatgtgcaaaaatcacaagctttcctatacgtcaataaaagagagctaaatcatgagggaactcccattcacaattgctacaaagtgaataaaatacctaggaatacaacttacaagggatataaggacctcttcaaggataactacaaaccactgctcaaggaaataagacaggacacaaacaaatggaagaaatttagatgcccatggataggaagaatcaatattgtgaaaatggccatactgcccaaagtaatttatagattcagtgctatccccatcaagctaccattgactgtcttcatagaattagaaaaaaaatactttaaatttcatatggagcccgtatagccaagacaatcctaagcaaaaagaacaaagctggaagcatcacactacctgacttcaaactatacaattccacagtaaccaaaacagcacggtactggtaccaaaacagatatatagaccaatggaacagaacagaggcctccgaaataatgccacaaatctacaacaatctgatctttggcaaacttgacacaaacaagcaatggggaaaggattccctgtttaataattggtgttgggaaaactggctagccatatgcagaaaactgaaactggaccctttccttaccccttatacaaaaattaattcaagatggattaaagacttaactgtaagacctaaaaccataaaaaccctggaagaaaacctaggcattaccattcaggacataggcatggacaaggacttcatgactaaaacacaaaaagcaatggcaacaaaagccaaaattgaaaaatgtgatctaattaaactaaagagcttctgcacagcaaaagaaactatcgtcagagttaacaggcaacctacagaataggagaaaatttttgcaatctatccatctgacaaaaggctaatatacagaatctacaaggaacttaaacaagtttataagaaaaaacaaccccaacaaaaagtaggcaaagtatatgaacagacatttctcaaaagaagacatttatgtggccaacaaacatatgaaaaaaagctcaccatcactggtcattagagaaacgcaaatcaaaaccacaatcagataccatctcatgcccgttaaaatggcaatcactaaaaagtcaggaaacaacagatgctggagagaatgtggagaaataggaacacttttacactgttggtaggagtataaattagttcaaccattgtggaagacagtgtggtgattcctcaaggatctagagccagaaataccatttgacccagccatcccattactgggtatatacccaaaggattataaatcaatctactataaatacatatgcacatgtatgtttattgcagcactgttcataatagcaaagacttggaaccatcccaaatgcccatcaatgatagactggataaagaaaatgtgcacatatcatggaatactatgcagccacaaaaaaaaggatgagttcatgtcttttgcagagacatggatgaacctagaaaccatcattgtcatcaaactaacacaggaacagaaaatcaaacaccgcatgttctcactcataagtaggagttgaacaatgcgaacacatggacacaaggaggggaacgtcacacaccaaggcctgttgtggggtggggggctagaggagggagagcattaggagaaatacctaatgtagatgacagggtgatgggtgcagcaaaccaccatggcacgtgtagacctatgtaacaaacctgcacattctgcacatgtatcccagaactgaaagtataatttaaaaaaaatgtaaataattacaaatactggccaagctgcaaagaaaggggaacacttataaatggttggtgggaatgtaacctagttcagttactgtgaaaaacagtttggaggcttaaaacaggtctactatttgacccagaaataccattaactgggtatatacccaagggaaaataaattattctaccaaaaagccaggtacatttgcatgttaattgagtcactatttatagcaaagacatggaatcaacctaggtgccaatcaacagtggattgaataaagaaaatgtggcacatatacaccatggaatactacacagccatacaaaataatggaattgtgaactttgcagcaacatggatgcagctggaggccattatctgaagcaaattaatgcaggaaaagaaaaccaaatactacatgttctctttataagtgaaagctaaacattggaaactcaaggaaatacagatggtaacaatagacgctggggactaatagagggggaagggagagggaagggttgaaaaactaacttttgggttctagcttcaatatgtgggtgatggaatcatccgcacctcaaacctcagcatcacacaatatacccacataacaaacctgcatatataacaccctgaatctaaaataaaagttgaaaataaataaacaagtgagcataatacctaaatgaacttttaagaaccaagcaaaaatagaaaataaatgaaaatgttcattgatttttaaatgctcactgaagaagacataattttgataatattatcacataactctagtggaatttaagatcttattacatcatgaatatatcatttctaaattttgattgtatatattacaaaataaagatattcatttaatttaaagagtcctataaacgcaggaaattttcttgattttattttttatttcattgtctagataaatttcataatataaccaaacaaattacatgtttaaaatgaaagcattcttacgatactcaattgctgtatacttatagtcatcatgctggttcctaatgatctgacagtctgtcaaaaaaaatgaaaatagtcattagaacattccctttcctttcaaacttagattgtaacaattataatgccatgaaagtaagtcatccaatcccagaagacaacatgcatgcataatttaaaataataggccatagtatgttgtttggtctaattagtgtcataaatagtgcacaacaataactggatttacaagaaaaattttaagctattaaagagattttgggcatcatacaaatgataaaatagaggggattttggaatctggacagctgctagagatgtgaaaggaaatgagatatcatgagtgtgtcagatttcacgtattcattgagaggcatgaaatacatttttggtgagctgcacatttgtccatgctttgcttttctttttctttctttcttttttttttttttaattgagacagtctcattctgttgcccaggctggagtacagtggagtgatcttggctcactgcaacctctgcttcccgggttcaagcaattctcatgcctcagcctcctgagtagctgggactacaggtgcacgccaccacgcccacctaattctttgtagttttagtacagacggggtttcaccatgttggccaggctagtctcaaactcctgacctcaggtgatccacccaccttggcctcccaaagtgctgggattacaggcataagacaccatgcccagcctgtccatgcattttcaaaccaagggtcattgaattatgcctggtgtctacactgtatttgagacttcaactaaaaatcttatcttttaaaatatggagtaagagggagaacagcaaacacaatgaatggcttactcaacttctcttcaacttcattttgatagtgtatgtattgttttgaagatatttttccttttttgtgttggttttaataaaaagtgtttaactgtgtacattgggatcaataatatcttatttataaaaattagacatctctattacagattcttgctgtctggcatgtaagaatgatttcaggatctttatcaggccagttgtgaagaccttcatagccattatttttcatctaacatttaaaaaattgttattagcctgtaatcccagcactttgggaggccgaggcgggcggatcacgaggtcaggagatcgagaccatcccggctaaaatggtgaaaccccgtctctactaaaaatacaaaaaattagccgggcgtggtggcgggcgcctgtagtcccagctacttgggaggctgaggcaggagaacggcgggaacccgggaggcggagcttgcagtgagccgagatcgcgccactgcactccagcctgggcgacagagcgagactccgtctcaaaaaaaaaaaaaaaaaaaaaaaaaaaaaaaaaaaattgttattagtggccaggtgcgatggctgatgcctgtaatcccagcactttgggaggccgaggcgggcagaacacgaggtcaggaaatcgagaccatcctggccaacatggtgaaaccccgtctctactaaaatacaaaaacctagccaggcatggtggtgcatgccagctactcgggaggctggggcaagggaatcgcttgaacccgggaggcagagattgcagtgagttgagatcaagccactgcactccagcctggtgacagagtgagattccatctcaaaaaaacaaaaaaaaatgtttttagcattatattaatgcgtttatgtatttatttacatattacatagtaatacaattaactattttggtcttcttaatatagcactttgtcgtaacattacgtcaatgactaaaacaggttttggaaagaattagcattctgctgaggcagacttgactgcagactgagaagaataacgtatataaaattactactaaatgccttcctagggtcaaaataatgacagatgttaaaaatgcatgccagtgtaaaattctcagattaatttccagaaaattaagtaaacactatagctgcatataaatctttggaactgttcttattgacctttcatctgtctttgctgatatctccaaattgacactacttgccatggtctctaaattgtataaatgcaatttggcttgaatgagcatgggaaatccccaccaagttgcaagttagggaaatgtgtcaaaatatttcataagtaaaaggactatgaaagctggtccactgagggatcctaatggagctccggccaacctcctccccagtaagatggccagggcagtgtgcccacaggactccaagtgttctgaagtgcctgcagtatatctgggggtgtctggcttccttttgtattgagaagtgacattttgcattatgggatgagtaaatcgagcctcaccatagtttggatcagcctatctgaagtaatcagtgtccttatgctacgagtacataaagatgatcagtgcagcccagctattccattgtgcctcaacatgtcattctgttcagagcagagtctctctagaagctcagcctgtctggctgtcactacagctcggcccattgggagatgtacatgaagcatgaacacccacatcttcacccagttgaaatgcatccaaatggaggccattttctaggccaggggttgtcagctccctgggtggcaaaccggtacacatagcaggaggtgagcaggaataaggaagcattcctgcctgaactctgcctcctgtcagattggaggtgggattacattctcataggagcgcgaaccctattgtgaactgtgcatgtgagggacctaggctgtgtgttccttatgagaatcaaatgcctgatgatctgagtgaaatagtttcatcctgaaaccatcctccacccccttcatggaaaaattgtctttcacaaaactggtccctggagccaaaaggttggggaccaatggtctaggtgacatcaaagtgagacagtgggaaccactgtctcagcaacagccctctgacttgtggatgcttccaaagagccttcactttgtgtaaagggtcatcttcccttccctttccccacatggcctctactcctgccctgcaaatcctatctatgatggtccatgacctgggaagatgggagagggaaccccaggagagatccccactatccaactccaaggacgtctgacgtttgtggaacactaagattatgaaagagaaacaacactgcagtgaggaccgctgattctggggcaaataaaaataatgaagtgagaaatgaagaaccttgaacaattctaattccttaagagatgtgagaacatacattaccataaaataggtagaggttgcaatgaggaaggactcatcagagactaagaaacaactcttggaaattaaaataaggctgtcaggtaactacccatgaagctgaattccacactagtcagctggaaaaaaaaattttttttaaagtacagaaaatttcacagaatacaaaataaaaaggcaaacagataatatgaaacaaacggtaagagaaatggaggctagacccagatggtccaataaatatctaatacaggtgtttgaaggacagacctgtggcagctgaagagcctttcttctccaataattaaaacataagtcctgggattcagtctcactggactaacttgaattgtaaccctatccttgaagcaattactgtaccagaaatatggagaaaacatgaaagtgatatattgattttcaaatgttaagatggcttaaagacagaacaaatacgtaaaaatttatggatctgaatgcaaatgttatcagtcttgcctatgtaaatataaagttgcagtttacataagatgagaaaaagaactacataagatatgtgtagagaataggttcctaaaattgaagcttcaagtgatgcttaaaattgtcaaaaacagaaaaccatttatgtaccttatttaaaggtactataatattaactgaagaactaaaataactttccttaatttaagaagagggactgtcaagctaaatccctcctcttatgtagaagagaatcaacagttagtacctaaagctgataaactgaagaagtatgttatttacaattacagtagggaacaccagcagaatttaaaagagaaattattacaagttctctctggagagttggatttggtttcaaaatggattgaggggattctattagcttttatttcatacccttctctatttttaaaaaaacaatttgcatgtagtcagccctctgtatctgtgggctccacatccatggattcaaccaaccgtggacagaaaatattcagagggaaaaaaattgaatctgtaccgaatatgtacagatgtttttccttcttgttatttcctaaacgacacagcataacaactatttatgtagcatttacattgtattaggtattataagtaatctagaaataaagtataaaaagggtgtgcatgggttatatgcaaatattacaccattttctatatcagggacttgagcatcccaggattttggtgtccctaggtgtcctggaaccagtcctccatggatacctagggacaattgtattattttgtgatacaaatgtgtgcataaatacatgagtaaaatatgtaattataaagctagaaaactttagattatcttagaatagtatctgtaaacatttaaatgatattactatgtatatacataaaacattgcgtgagcttgggaaatatacatatttttgcacttgtaagaactgttaagaggtggaaaatatttttctattctagcagttgacagtttctttctgtaaagggccagacagtaaatatttagggcttcgtgatcataaggaacaattcagggcattatgtatgtacatatataaccagggaaaaaaatcccacaatttgtattgtcaaaatttagaatatgataaaaattgactatgattttgtcataatacaaatttactaatgagaagaacaaaaaccttttttgaggggaaaggtgataatattttgtttagttgcggttcaaagtgagtgttctctcttgtcaacccagttttaacattcatctgtaaagacagactcatttgtgggccgtaaaaaaaaacacacgtgctggaccggattttgttcatgggctacatgtagttcgccgactgccgctctatttagtctgctcccatttagctggaatccagacttaggatttctcagctctctgttgtgaatcgccaggtttcttctcagtttgttgcagaatcaatactctgttaaacaaaataaaaactgagttactataaaaatgaaatttaaaaaaaaagcagacatacaaaatatagcccccaacatttaattattagaattaataaacaaaattatcctgctaaattactacaaaagtttctgaacacttacattttcaatttccatatttatatagtggcaaaaagataataaagagctttgcagcctgatcccaaatagttccttcatctttttggacttttaaaaaatatattttctaactgcattgtagtataatttctaacatatatggcattgccaaaacttggaatgtgcttttctgcatcattagtgacttctgacttctccgattggaacacacgtatgtttgtttcctttgcaggcctaattggcaagactgcagataccctagaggaattgaggaaaggtggataaagcaactgattgctttttttcaggaccctttagtctatttcctttgtgaattcgttcatttggaggacaaccttagaatgagcattagttaccagattgagccatcaactatcttccgagagacaaactataatttcctgaatttattacccaatattttataccacttgtcttgcagtattttgctgttataagatgcatttattactgatgatttccatctactaaggcgtaagtcaaaccagcattccattttgtcactcttctgcatttcatatttagccaacttagagttcgatggaatagaaatacgctctatcgaaattactcaattactgtattcaaaagtttccacaaatgctgtaggtactaagagaatatttatgtaaattcacattttccaaccatgctcatctatgttagtttaaaatgcaagagttaaatttttcattttgtggtgatactattcccaagtgcattatgttcattgctttgaagaagcatctattacatcttaaaacacacttgccatcattttctttctttgtaagaatgaaaacactttagagctacagcagactcttaattaacttaagaaaaagatgaaaaaaaaagccttgcttcctttctctgtctctgtcaggctgcaggaggactacattcttgagtaggaaatgaaagatttacgacatttttgagactacaatttttaatgagatgcacattccttttctcatgtaagccttgtctcagggggtctcggagcagagagggaagggtttttttgtctgcgtctcctgatggtcctcactggatacgttttgtggagtgttcttctgtttaagaattattttctttcatatcgttttccccattaaacacatatcttatggcatatttgttttgtgccatacaaaggaaacgaaaacgctaagtcctgtttatagcaaccgtttacctgagtatctggaatctatacagtgcacgattttctccaaattacttgtatgtttctattctttaaaataaagaataaggtaattataaaacagtattctgatgtgtaacttccaagatcctaatttctctcatacatattgctactaatggcctgacaaaaaagaaaatatacttcatatacttttctttacttcagtcgcattaaacctaaactgtgtaaaattgatccttcttgaatacagagttggagctcaaccattgttgtatgttctcatgtcactgttagaaaaacaaaaaggtgcttttaagatcaaagaacaacacaaacccagaatacacagtcatggtttgaaaacatagttttagaaatgcacattttgatcttaaaagatcaatgaaggaaagggtttgtgtactagactctgccacaaatgagtacctatattttgcatgtgacatgctgaatgtaatcatatcaacactagtgaatgaatatcagggtatgccacaaacaacagctcattctgattaactggctcatatgctgttttcagtcttcctcttgggagaaaagtatctcatatcaacaaagttgatgtttctacaactaatgtaattccaagctactctacatagcctaacatagagcaaccatgaggttttaaagcatttttcttatagaatattaggactcacaaatacacttctaaatctgcttcaaaataccttgagttcttatcaacactgacactaagttatcccaggtatccatattataaataagcagataagaataatttcatatttttgcaataaaaggatgctatgtagctcatactgcataaaattttcaaaaatataaatttttggctccacggccttcatttcaagcatcttctaaatgtgtgccatttctgcaatcagggagatggcggctggacagcaatctgaaggtgctgattagaggtgttcagggatgaacccaatcaaaacagttaagggcaggaacctgccagttccagggagtttcacactgaatggaaaatactgagtaatcagaatttcaagcagtggccaatgacacagaaaactcataaacattctaaaataaaaatgttgcaggaatgccacctaaagttttaaaaatctttaacaataataataatagttaacatagatgaagtgcttactatgtgcgagggactcttctaaacatttttacatcatttgattcttacagcatttctgtaagtatattattatccccattttaaaatggggaaataaaaacacaaagaagtcaatatcttgcccaagattacacagcacagaaattctgtaaataagattttaactctgatagtttggtctagagcctgggctcttaaccactaggtataatggtaagcaaacattggtgaaaaaaaagtccttatctaaaactatgaaaattaatgttaacatcatcaccaccaccatcatttaaatattggatatgcttgggtttaaagcacaatttagttctgctacttaggagctccatcgttaacatgtttcttaacctctgtaaaatggtacaatagctgtctttcagggttactgcgagattgttatgaatgtatgtaaaccaccgacacaacctcctggcacatcgcagttgctccaaaaggggtatttttattataagtatgataacggaagtgatacatgcatgctgcttacattaactgcttaccagatgattaagcagatatgtctgaatatgaatacaaaatataaatcccacaccagcaaacgtctcaataaaacatttcaaaaaatgtattgggtcatgaaaatgaacttcctagatgtagtgttttacggttgtgtatcacatacgtataacttagggcataaggagaagtctcggcccagacttcacagcctcagttttgaaaaaagggtgtccatggtaggtgtttgatacgtgcttggggctgatgtttatgctgagtttcaatgatcattctcccacattaacgggtttggctgaaaatatcaatatgcaagtagcagatgtgtatagcaactcaaaatgtttatatagcatgaaactcatctatgcaagacagagactttgctggtatactctccaaagcttgaaagtagaggccatttagccgtaaggcaacggtcccaatctgctggtccctaacaccaccccttaagggttcccccaacctacagtcgcaccaagtactatttgcaaactaatcacaagctgctattctgattaatagactacaaattaactcggatggattgttaaggtcatagtagcatgtgtgtgtgtgtgtgtgtgtgtgtacagaagattttctttctctggggtaaatgcccaagaatgtgactgccgagtcatagggtaagtgcatttttaaagatttaaaatgaaatatacttgatttttagagcagttttagagcaagtgaagaaagtgcatatataccctctccctccacacatgcacagcttcccccactaccaacgtcctgaaccagagcagaacatgttagaatccacgaacctacttggacacaccattattccccaaagtgtctgtggtatacattaaggttcgctcttggtgttgtatattctacaggttttgacaaatgtataaagatacatactcaccattttagtaccatccagcaattttcattgccctaaacatctactgtgttctgtctcctcatccctcccttctaccccaattcatggcactcactgatctttttctgcctttttcagaagatcatatagttgcaatcacacagtatgtagccttttcagagtggcttctttcactaaataatatttatttcaggatcctccatgtttgtcttccttgatagttcagttccctttgttgaggaatatgagtccattgtccaaagtggcacagtttttttatatagtcacctgctgaggggcatcttgcttgcttccaagtttgggcaattatgaataaagctgctgtaagcatcacgttttggtttttgtgtggatgtaagttttaacgcatttggttaactatcaaagagtgcaattgctgaatcctatgataagaggatgtttaatttttaaagaaactgccaaactgtcttccaaagtgggcgtagcatgttgccttcccaccagcaatgaatgcgaattcctgttgctcctcagcagcatctggtgttcatattgtagactttggccatcttaataagtgtgtagtgatatttcattgctgtttgaccacagtagcttttcatcatgatatagtatctcagtaaaaacacagaaaaagtataattactttatcataaggggaaactcaaaattttgttggaaagagggactctcatattcaaagaggtaagggatcactaagtaaaaggatcctgatgagaaaattgtacatttcaaagtacttgtgcaaaaatgtccccttttactttctggccacacaccattcctttacctgaaactctggtgcagcctcccagttcatgctgtgcctcctatttcttcccaattttatattccctcaaagcacataagggaaaatttctctttctctttctcaagagaaattctctaaaactgtgctccatgagatcctggtattatgcaagatgtcgttaaaggctctatgaaacaaagttccatctgtttaatataactcgttacacttctccttctctccatgcatggagatacacaatatttaatggcccattaaagggtttgagaagtattagaattaaaacaattaataaagtagcattccaaactatattcacatgtcaggggccccatgggtaggcggtggaggagagagattcagcagaattttttttcaggcagcaccataattacctagaaaacatcatgattagaagaagtcatgtgtctaagactgtcctttctgaaacaagggagcaatttctactttaaagatttttaaagggtgagagtggctgggcacagtggctcaggcttttaatcccaacactttgggaggctgaagtgagcagatcacctgaggtcaggagttcaagaccagcttggtcaacatggtgaaaccccctctctacaaaaaatacaaaaattagccaggcgtggtggcaggcacctgtaatccccgctgctcgggaggctgaggtgggacaatcacttgaacctgggaggcagaggttgcagtgagctgagatcacaccattgtactccagcctgggtgataaagcaagactccatctcaaaataaataaaattaaaaataaataaataattaaaactgtgagagaaaatatagtggagatatggataaagaagtcagaggagtatgcagcacatcacccttccttagaccatcagtaaaagtctgcaagatgaggaaagtggatggtactggatttcctatataaaacagtgacggacggaccagcacacaaggtggccacatggacaagggatagtctgcatggacaaggcacagaaggccgttgtgggccctggactcctgtcaatgagatcactcagctctccctaccagccagaattctgcccactcgagttaacccaagaagctcaactccagatacctgaaaccctttagaacatcatatgataagatgtaaacagtgtaccctctcatttctgatggcttaaactaactatgcattcattaggtataactataaattcattagctttttccacttaaacctggccaggccacatggaatctttgatcttgagccatacttttctccagacagagactgataaatgactttttctggtagttagaactgaatctttattcattgtttcagtatcttcactcttttatgctcctttataaaatactataagaaaaatagacatcttcattaaatagaattctttaaaaattgcctttcatggtatttgctaaattttatttgcttataatagatgatgctcaacacaaggccagctgttgatggtgtgttattacgtaaaacttgtaaacaaggaagcaaggaagtaaactgtttggtccataggcatgggtccacagaatatctaccccagaatcaacacaagtgggttctcaacatgctgattcctaaggctgccctggacctattaatcctgaggacctgggacgtggccaagcaatctgaaagttaatggtctctgaaccactgggttggatcttcatagacagcaaacctggcccaaagaattactcagagtacaaagagaacacaaaaggatgaagaaaaagtagttggaattttgcaatttaggggctgtaaggggccttaaaagatcatctagctcaaccctatgtctttatagtagagaaaaatatgttatttaacccagatcaccaagttgaatcagttgacattctttcccatctaaaatgtcgttagtctagaaattgaagaaatgaagaaaatctgaaagaatggaaaaggaaagaaacatatatctggaagaagtcaactaaccagtttcagagaaatgttctaattgttcaagatgtactcaacttgaatctgtgatcttttctaaagacatttttttaaccttaagatttgcttttcagtattagtattgcttgagacaatagaagctaaatatttgtggaaatctacatcatgaacaggtactcgcttgggcagcaaattacagagtaagtaatcattttctaatttcaaggttcctattcttttagtcatttaaaattcagacttcaagccaatctatgaatgccaggtttctgttaattacaaacaattcatcttaattagcctgaaagatggttctaacaagaaataaattattgagcacaaaaagcaagttttatgacatgtttaatgttcatttcaaatccctttcaaaacaaatagcagtggagaacgtggagggttagaaagataacttttgttgctggattgatttcaaatcttccctggctgcttgcaggtgtagcactgttcacttgaaaatttattgtaacagatcacaatcattacaatcatgatggtaatcaatgttcattaaagatacaatgaaaattccatgattaaaggccatttgtttcatcacaataagatcatttatttattattgggtaaattgttacaaattgcatatgtttggggcagttgaaacagggaacatgaatttggggattgaggccgtgagtgccttttacttggtgaaattctgacaattcaaagagaagactgcatgtggcccgtgaaagaaagacaggctgtgcttttactcaccacaattctacactgtgatctgatggtcattattcctcccaactcggctcttcatttttctaaattagacaatgctgaacatatcctggtgcctttgcgctgtgttataaatggttttaagcagcatggaagttgcactgttctttatttaattccatcagcactcttagctagtctactatgtaaaaagagagttgaagacattatatgggcttcttctctttatttttgttttcgttttaaaaccaaagcaaacatctcagatcaattcaaaaggaatgagcaggaaaccctcaccaagatggaaagtgctaacatttcacatgaaaagaagttttttccctgaattatgctccctgtttaaccatctaactcagattaacactatcttacttgacagccaccagcaagattcacctacccctgccattcaaattccaaacagtcagtacaaacaaattttttttaaagacgaattcaactgttctagtgtaaagctgttttgggctcatctgcaggccaaacacattggctcagagaaacctgtttgctgtcagacaaaggctgttgctgtcattaagagttgttcttagagggtggccaatcagacacggtgagtcaggtggtcccaaggaaagagaaagaaaatgccacccacccactctgcgaaggctccactggaaaggttccatatgatctggctgtcattgcccttgaattagggctacgggaacaatttgccttacgattcactgagcaggaaagggtcctcgtgttcccttgtgtacagagggtgcacatttccctaaactctcctacttggaagatggacaattgccgaggaatactaaatatggccagcaaattttgtccccaagaaatctgagtgatctctgaggtcaggcaagaatgtgatagcaatttagaattgggcggggtagacaattaaaattagtcatgaggaaacatgcaaaaaacttttgccttctctgacttccgatcccacgaagctgacttcatgttgctaaatattccgattacaagtgaaaaactcagacatatgaaaattctgtttatgagaaccaaaatctacaaagaacacatttttccccaagacactaaatttatgaggtctcaagtttattagtcagtccttagttcctatttgaggttcctattttgagccctcaacaagagctaagaggttatgccttgattaagaatcaatcagaactggagttttactcaatgatatacttaactccttacttaacctgacttagcacaattaattatataagccacaatttcctactccttaaaatgaaagaaatagtaatatctgtgccatggaaatagtaatagaattaaatgatacgatgtatggacacatcctatatggcacatgcttaacaatcaatgaaagctacttacaacaacaacaaacaaacaaacaaacaaacaaaaaacctagggccaggcacagtgactcacacctgtaattcaagcactttggaaggccaagatagaaggattgctggaggccagggtttccgtgagctacgatcgcactgctacactccaaagatctctttttagcctaggagttaataattaatttcatcattatttattgttctatttgatgtaaccacatacagaaactggaaaacagaaaaaagaagattttcttagacacacagaccgatggaacagaaaagagaactcagaaataagactgcacacctacaaccatctgatcttcgacaaacctgacaaaaaaaaaaagcaatgggaaaagggctccctatataataaatggtgctgggagagctggctagccatatgcagaaaattgaaactggaacccttccttacgacatacacaaaaattaactcaagatgaattaaagacttaaatgtaaaacccaaaacaataaaaaccctagaataaaatctaggcaataccattcaggacatagaggtatggggaaagatttcatgaagaaaataccaaaagcaattgcaacaaaagcaaaaattgacaaatgggatctaattaaactaaaaagcttctgcacagcaaaagaaactgtcatcagagtgaagagacaacctacagaatgggagaaaattttttgcaatctatccatctgacaaaggtctaatatcaagagtctacaaggaacttaacaaatttacaagaaaaaaataaatatccccattaaaaagtgggcaaaggacatgaacagtcacttctcaatagaagacatacatgtggccaacaaacatgaaaaaaagctcaacatcactgatcatcaaggaaaaaccacgatgagataacatctcacgcccgtcagaatgagtggcattattattaaaaagtcaaaaaacaacagattctggcaaggttgtggagaaaaagggatgcttttacactgtaaatgggagtgcaaatatttcaaccattgtggaagacagtgtggcaattcctcaaagacctggaggtggaaataccatttgactcagcaatcctactactggatatatactcaaagggatataaatcattctattataaagatacatgcacatgtatgttcactgcagcactattcacaatagcaaagacgtggaatcaacctaaatgtccatcagtgatagacaagataaagaaaatatggcacacatacaccatggaatactatgcagccatacaaaggaatgagattatgtcctttgcagggacatggatggagttggaagcagtatcctcagcaaactaatgcaggaacagaaaaccaaacaccacatgcaatcattcataagtgggaggtgaatgatgagaacacatggacacatgggggaaggacacacactggggcctgtggaggggtgcagggagagggagagcatcaggaagaatagatagtggatgctgggcttaatatctaggagatgggatgatctgggcagcaaaccaccatgacacatgtttacccatgtaacaaacctgcacatcctacacatgtacccctgaacttaaaataaaagttgaagaaaaaaaaaagagatgctcccaattgcaagatcctaacaacttctgttagcattttggtataattttcccagcattttttcctggctgcatttttttacattctctctctcgcatatgtgtgtgtgtgtgtgtatatatatatatatatatatatgtatatatatatgtgtgtgtatatatatatgtatatatatataaaacctatatatagtccatatatagagatatatatgagctgtctttccaacatttcttatagctttaatcatgaagtaaatcaatgtcataataaattttggccctaattatctgccattgtttatttgccttttttcaaagtcaattagaaaaagagagaacattattaagtatttattaagttaaagctccttaatattaaaaagattaatataggagaagatatgaggatctaagcctaaaccttaactggcatgaaaaaaaaatgactttatccgatgctactttgtttcatttaacacagtacactcatgtaggatgttctcttctttccctctcaacagaggcatgtggcactctaagctccacattgctgagttatctttaacttaggtttttctacgagaagaaatatgtgactgcatgcaatacaagtacctgcagagatttagtttagccttgggacaaaaattcataatggctaatttaaagcacaaaggtgacgccaccttgctggaatgaatttagagttgtaacagttgtaaagcatcagtcctgtagtctggatactcggggttgttgctactttctgtttgatttggactcaccatgatgtaactctggcaccactgagaccacgcctggaaaatgcatattcatttgatgccatatataatcaaccaaatatacattgtgtccttattttgatctagtcaccagtgatacaacaataaacaggaccagtctctgacctcaaagaattcatctagtcattctactgagctgatgtgtgccaagattgagttacaatcagcctagaacagtagcaaccatagacacttccagggtgtcaggctgattccccatcttctaaaatgcagtacatttcttgaataaattggccacccaaggcagacatgtgcctcttcactcatctaattcagttcatccatccatgactttagaattgttcaaaaattgcccagcttcctaataccaacaaatattgatacttccctgttttattttagatcacatggtatcttttccctaaatgtattaggtatatttgttaaatagcagactaccaatctggggagcaactgaaatcagaaacatagtgaaagtacccaagatgtatatatgggaataataatattggtgattactacaaggaattcttgtgagaattgaatggaaaattatatacatatatatatttatatatgtaatttttaacttaatcttggcccacatcacatagaaatagtagtagcagatattgtcttcatcatcatcaagataataaaaccatttcagcccctttggaaaataatttggcatttccgcaaaatgttgtgcataaacctaccatatcaccaagcaattccactcctaagtatctgtccaagagaaaagaaacatctatctacataaagacttgcacatcattgtttataacagcattattcataaaagccaggacctgaaaacaacttgaccacccctcagttggcgaatggataaaaatatggtctattcatatgatgaaatagcattggataataaaaaggaatgaactgctggcacatgctacatcatggatgaacctcaaaaacattgccctaagtgaaagaagccagtcacaaaagaccacagactgtggattccatttttaatgatcaatactagattagtagttgcctggggattaaagtgtgaaaaagaattaactgtaaataggcagtagggattttagatggggcatgaaaaaatgctccgagatcgatttatggtgatattcctatcatgccacagagttacaaaacagtcattgaattgtatacctgcaatggctgaactcttatgatatgcaaaacagacctcaataaagttcttacaaggaagataacagaaccaagttctaagtacaccaattatccagttgcctcctttgtatctttcatatatttagagaatctatgtccactaaaatcgcatttatccagttaaagatgagattaagaaattgtgttttcctgttgatagcctgaaccttaacagtataggtaatataggacttaacgtgatttttagattcggaatgatatattcatttgtgaaccgttttctggatcacataaaactttattccaaacataaactgtagcacaaatgacacagtccttcttcacacagatacacacacacacacacacacacacacagccatcagtacgagcagaatggggcataacctttcattcctcacataacatctccacatgatcctcctgccccattaagaagacggcccaaaccaagtacctcaaatccagtgtcccaagaactgtttttagtgtttgaggttgtgtacctgtctttacttgttcccaaattattctaattctaatcctttcaggtctcattttgatcttcccagctctgatctcccaactctgtgaccccaagcttgatcactaactatagatttatggctttgaattgatctctctctctctctctctgcacagtttgtctcctgtgtgtctgtctctgggagaaaccctctgctctagccatgtgaaaacaaattctgaaccaggccttctgactctgtcctcatccctccctcaccatctcctaaacccttcgaagaggaagccatctttttcttttccacatacagagccttttatctgtacatctattatgaaatttaatactttctactatatattaaatatagttatttatgtagttgttgtaacctcaattgtttcatctttacttaatatctttcaaagcatggaatacagagctttgctctcaagaaagtatattttccgaagtgtcccgatagattgaaatatctgttaagtttaagtgaaagggttggttctgctacagtttatttcagttatcagtatagcacgcactgatgcctgagttactgctggaaaatactaccttcctgtcttcttaaggcattgcaaaaggtatggggaaagatcctgaatttgccccaatttttaaacaaaccagagaaacagtaaagcatttaaatgacttattaatgttaacctatttatatctacatatttgttagcctgtgagtaaatggaacttcggatctttgcaaaagaactgccgggttgtaaaaaggattggaaagtcaggctcacttagtagtgtgcagagaaacagactctatgcctggagcaaaaaatcccagcatcccctccacctctacggtgtgatttcttaatgctgtacttggctcgacaaaggaagtctgatatttcagaggtgagttgcaaagtggccaaaccactctttaatgcactatagcttgacataatatttgctgccagcttctcgtttaaaaatgccatcagtttaacattaactgaaaaagtaattattctccagtttcacggagctattaagaaaaaaaaagttcattgaaactccaggaaatgaaatactgtgctttcaggacctattggaagcctttcaacattcagagcagaaaaacataaatttattttttaagaagcagatttaggaactttagtgaatgggaacagaaagcattaacttaagcctcaggggagataacgattcaacaaaattctgaaaaccctccttagatcaaactctcacatattctgaaaactcagtaccatttattgttacaagatccttgatgatttagaaacatgtacccacacatgttaagtcctctgtactaaatcaaagaaacttcaaattagcttgaactttgaaatgctgtaagttacatgaatgatgattcatttctttatattcagtcaccaaatgttattgagccgatgataagcttgaagacgttaaaggctttggggtacagaagagagatactaaagtaacagcctgcacatgagatcttgacctgtaatgaagtgccaatttagttgtaaagacagaacatgtcatctataacatctgaggaaaatcttgctgtgtatgcggcataacctcagtttataaaaatttgagaggaaatcacaagaatggagaggttttgcaaggttatggagtttgtacaccatttttttagaacatgaggtctaaaatcagatgcaaatgtgggctccacatcctattttttaggtaactttgaacaagtcacctctttgaacctcagtgaaatgcagctgaaagttctttgaaaactgtaaagattatttattattcagagatgatttctgtgggtataagcagaaaacactactttttgaatgaattacaaacataaaaccatgactttaatgctaacattttttgaaatttttataaaactttctaattcacgttcccctactgttccaaagtcagtaattttaagatacatgatttaaaaaggaaaaaaaaaaacctaactgtcaagaaatatcgctaactagattgatcatgttatttccttatttttataattgaaaaaacccaaaactttaatactaatttctggttgcttaaaaacaaattaaatataaaactgtgtggctgtcatagatgatgatattttaatctattgaaaattattacagtagaaaatttttaaagtctaggaagcaataatcagcaccaaaatattgtttttgctgttgtatgcacagctttagtttccattttatgaataaatacataaaaatatagggtaaaaatatatgtatttaataggattcttacaactttctattagcacaatgagtgcagagcatttgtgaataacatagaactagggtctcccctacagcttttgagttaagtctttttctaacaactgctatttattcagagaggatgcgaagtaacaggtctaaacattacattggcaaaggagtacctttaaattgtatgtggcacaagctaaatctgggaaaggaaatgaaacacaaatgaaagggcaacttcttctggaaacctcccttcctttgtggtatttttgtccttcctccattccatgaatcctattaagaaaaaaatttctcttttgctttctaattcccaaatctttactgcttttctttaacaaggcttccaagaagaatcggaaggtgaaggaagggatggccataaagaagactgttctttagatgagatttttgtcatattgttactgaaacaccaggggtttggtctaggtccccgctgctcccaacacataaggccaacgactagggtgatgagtatcgccaaggaagaagctctaatcaggtgctgcaggccaagagatggcagctcagtctcaaatctatctctgggacctactcaaactaggagtttatatagcaggaaaggattgtaacaacgtgtaagaaaacaggaactagggaggggaaaggaagcaatcatgatgaatgagggatctggcatctcattgtctggatgtgatgatctagtgagtttcagttctttgatactttttttgagaggtctgaagggtcatttcccaaggaaggaactcagataaaacaaatgtaagtttcaagctttaagaccagaaggattggctggtcacagtggcccacggctgggcgtggtggctcatgcctgtaatcccagcactttgggggtccgaggcaggtggatcagaaggtaggagttcaagaccagcctggccaacatagtgaaaccccgtctctactaaaaatacaaaaagtagccaggcgtgatggtgcacaccggtactcaggaggctgatgcaggagaatcgcttaaacccgggaggcggaggtcgtagtgagctgagattgtgccattgcactccagcctgggcaatagagtgagactccatcaaataaaaaaaaaaaccggaacgatcaatttctatatttatccaaacatgattgtctatgggactcctggatcagtttcaggcctccctttctatttatcaattcctcaatcatggggaacctggttgttgatcttcctggctgcttcctgctgaggaggggtgtcatgggcagctccataccatgggtgaccacatggccactcaggaatcaaaggttaatctcatattagagttttgttctgaaacacagtatttctctctccagcccccccacatccaccagagacaaattgttactgaaacaccagtgatttggtctgggtcctgctgctccccagacagaaagccaatcgctgagacaacagtgttgccaaggaagaaggctttaatttggtgatgcagcaggggtttatatagcaggaaagaatgtaacaatgtgtaagaaaacaggaactcgggaggggcaaggaagtgatcctggtgaatgaggggtatggcatctggtgtggtgatctgggttctttgatgctttttgtaagaggcctgaaggtcatttcttgaggaaggaattcagataaaaccaatgtaaggttcaagccttaacagcagaagggcccatttctatgtttatccagaagcaactgtctatgggactcttggggatggtttcaaaatcacagcaggaccaatctacctgcaaaataagcttcagtcccatatactagcctgattactcacacagaatgcaacaagatcattgtctacataggcattcctagacttgctttgctggagcctctgacaaggtcatttcagtcaaagccctgggaaataaccagttcctccaaccgggcggggtcggggggtccattataaaagcaaacatgttgttattatgcaaacaaacacattgccatgagttaagaatattcacaaatagtttacaaattatgaagaaattgagcagagagagaaataggcctcaatttctgtttataaaagtatactctattcggtacacttaaagcatacttaaagcctgtaaatatctcaaaaggaaaaaattattcagactctgaaaaacaaaacaaaaacaaacagcaatatttcaaacataaaaatcataaaagattatctcagtccttattagttcagtctatgcaatcagctcctgttctgcttcatattggattagtggcaatctttatacaacagcctttcaattaggggcctagaagttttctctctaatccaatggcacaatctccaaagttaccagaaacttccattcaagagtcctttttatgaactcttccaaagaagcaatgtttggactgtggctgattgtaagtcactttttgagaaggatcaaagcaaaacaacaattgtggataacaaaaagtcttgagacagccatagttagagacacagttgacaagaaaatttggttatttctgtggcatacaacaacttaataattataattattactgacaacatatatttaaaaataccagaattttaagaatctcatacaatcctggaacacatattatcaccacatttatataaatataacccaaaggaagataaacaccacctcagatttgacaatgcttcctgcataattctaacacaatgaataagcctattatgtctgtcttgcatgtcagggaacctaatatctagaaaagttagtttgaggacaaaaagactgaattcagaacttgaaattttactcctagaaagtttaccaaatatcaaagttttaagacacttaatatcacaaaataggatcacaagtcactataaaatagtccttcatttagccaaagtgataaatcaaaaacatttacgttttgatagagactctgtttcccaaacaaagacctaataaagacagcatgaggccaactgaatctgtctctccccactcccttttctctctgcaatttactcaaaaagtaaacaaaatcttttatctctcaatattacatattttgtttaaaaaaaccaaaattttcctttgaatggtatggtattaatgttaaagctaattttaataaaatattataaacaaatctatctaatttaaccactttgactataaggtacagatttctgtaaactttttttttttttttttgagacagagtctcactctgtcacccaggctggagtgcaatggcaccatctcagctcactgcaacctccaccgcccgggatcaagcaattctctgcctcagcctcccgagtacctgggactacaagcacccgccaccatgcccggctaatttttatatttttggtagagacggggtttcaccatcttggccaggctggtcttgaactcctaacctcgtgatccaccagcctcggcctcccaaagtggtgggactacaggcatgagccactgtgcctggccaatttctataaactttttgtaacctttttccaattttctattaaacagcagatcaatgcttcaagaaaactgttattccaagacatgggtccagacactattcttgtatcaatgagcttttgatattaatgttgtttaatgtatagaaaaactctgaactaatcctatgcctcaaaaatcagccctgacaatctcacatgactacctcttccacaataatccctgggcctagagggattaagtagttttaatttctggcctgtgtctcacgaaacagttccttgtgatcgtcaccttctccagagtctgaagagaaacctttgactgctgtcaatgctcaaaatttagcaggaattggtgccttcttcaacccaagagtcaaagccctgttacttaacagcacaagcgttagttaataggatgtttatactacagaaagtcctatcattccctctaacatgttacaaactaaaacactgtgatttggcatttgcgggttactgcctgcagcgcttcaaaccactgtgttaaagtagttaggttactcattgcataattgctaggattctagtgacagaactgtgaccaaaagcatcaaaacgtgacaggttctatgccaaacttttcaaagtaagacaactaatgtttcttgttgtcattttaaaaaaaatggtaaatgcaaatatcagttttggaaaaaatgtcatttaaaaaatggtaaatgcaaatatcagttttggaaattcagtataagaattaatcatctcctttcacttaaatactatacaacaaaacagggataaagtaaggaaaagcacacagcaatttattttcagctattttaaaagagcatcatcacacttttccaagattggtttctcgatgcagtgccgaccaccaacattttcaaagcagggcaacactggtgcatatcttgtttccaggtacacacatgaaggcccaccagtgataaacagcttaggatcagaaatcactacaaagtctcacatgttttaaatactattattgcttcatccaaatgaatgtcacttaatggtaataatgataaacacaactacaatagtttgaggaaaatcccaatcactataatttccttaaggaaaaggccaatatttcctgaacattaaatttgcatgtgtaacaggttttcctcattaaaagaaaagatctgaaaccaactcaaattattgactgtattgaattaccttggaaataaataccattgaaacatttttactctcacctactttttcaaataataaataatgtactatttctgttcagaagttataaaaaatcttttatgcagtttttttgccaggaaccttaaagctctcatagctctctagatcatcagaggtaaggaaaaccaacaaaattttaaatggctgatgtcctctatcaatttttggaggcttcacaaaggtatattaggaactttagatcaatagaacaaacaatgaattgttggaaatgtatagaaaacaaatgactacttatagaaccagatagtttcaagctttaagaccagaatggtcgatttctacgtttatccaaaaacaactgtctacgggactgttaggtctgttttttggggttttgttgttgttgctgtggttttgtttgtttgtttgttgacggagtctcgctctgttgcccagactagagtgcaatggcgtaatctcggctcactgcaacctccgcctcccgggttcaaacgattctccagcctcagtctcccaagtagctgggactacaggcgtcctccaccacgcctggctaattattgtgtttttagtagagacggggtttcaccatgttggccagactggtctcgaacacctgacatcaggtgatccatgcacctcagcctcccaaagtgcggggattacagacgtgagccaccacgcccagccgggtctgtttcaatcttcctatttgcagcagaattggtaaagtgagttaacagagtagcatcaaaatgatggtagtattgtgactgggacataagatgcatagattcatgatacagtgacaaaatgcagcgttcaaataggatcccccataactctatgctgtaggcatatacaatattgtgactagtccacttataggacatttctgtttccaaagttggcacgaaaaaaaagagacaaaaaacaaagacatgcccagcgaaggtcttgagtgctgggatctagttacaaaggtttgggaagtagattttttaatcttagaggactattcatggctgatactttctcaaatgtgccttagagatgcttccatttgcagcacacattccatagaccgcatcaatcactccattcagtcatccttgtctgtgtccttgtcttgccacgtgtgtctgctattctttccacaataggtgactctgggtccaggattcagacttgctttagccaataggatgaggtgagatgacagtatgggcttcacaaggttcacagtacctctgcttgcccttctgtgtctcggcctcagccatttttgggggtctcaggaggaagataaaagacaagtgggacagagccacacccaaggaccccaacccaacccagacggcttacactcggctggtgacatgcgtgagttggtgcaattaagactgcaacttctgatcctgtcctgcctggatccatccaccctgggaacttgtaagaaatagtgagtgattatagtttgaagtcattgagtttggtgtgcatgtgcctgtgcatttggggtggggggaggcaacaggtaataataaaggtaactaatctcaaaattgtggccttttctatttccaggacctctgtagaaatcatgtttttagtatgtacagactgaatgctaaacttttgtctccaaagagtaaatactgtccacaggggaggtctacagaaaagaagtaaatatatgagtcataatcagtctcaagatatagtacacatgtcactgaataaactgatgaaccaaatggctgaagaggaaaatttttaatgctctgcttcacactaataaaaacacagtaggctcaatttccatattctctgaaataatataaatgattttgcaatgatatatttacttacatttattctgctcattgaaatatttcctttaaggaaaaatacttggaatccaacaaatttcttcactcagtatcttcagcacatattcatacaggtaaataagcaaacaatttttatttaatatttaaagtatcaactaaaactatctgaaaattatcaagaatgtaaatgactatagagcagttaatttttttttaagaaaacttactgtcaacttgtctttcctttgatgggtgggataaaaggagtaagttacaatttcttccttcatctctgcctctttcaatgtcccttcctttatgctcatgtcagtctctctttaaccaaacttgtaagctaagtctggcaagacacatagcatttttcaagaagtcaataaacatttagccctctgaggagacatcaaagaagcaaattaaatttgttacaacgacttgatccgtgttcttttggtctaatgatttaagccccaaatccaaaagttaaaagaaagcagaattagttttaaatcactttgcacttaatctctctttgcctcttctctccccacagtactcattttttttacctagaatattctttcttaaatatactaggatacaaactctaatatacacagggaaatttgagcctttagtgcccaacagtgctcctcacagcacttagcatggggatttgtgacaggtgctcactctgctataaaccaatgttgtctgatacaccaattgacctagcatgaccattcatattgaaaatctttgtgttatcaaggttaatcttttcctattcacaaattccttgaaaacatgatacatagtgtcaaatattgccaaaattgtgaggtgttgtatctaaaactgcagcctttattttttaaggtgttataatagtaaaattccaggaagaaatatgccaagattgatggaaatactattgtgtttcacaaacaaatctcaatgtatttatatgtacgagtagtcttcaactttacaacaacagaaaaattaaataagaactctaacaaaaatttgtttttctttttgaatgttgaccaatttgtgattttaaaatttttacttgtgtctctgttaagtctttgagactatccattttgcttttctgatcttaagttctttccaaaaacacagaaactctccaagctgtcagtgtcccagatggaaccaaagttgtagtttgcactggacattaaatgccgaacttgaaattaatcagatctctacttgagtaaaatgaaagctatccaacgaaaaagcaccaaaatattgtacctacacagccaggaaaacatcaaaggccttcaaaaagctaatatatctagtgttgacaacctagtaccacacaagaactatgggaatgccaaggttacaatgtactaaaagcgcctccatgaagagatgaaatggtcaaatgtccaggactctttgagaaaataggggtaaatagctaaagaatattgaagttgctccaataatcaccaatatgtttcttctggtttttcttccccaactagaattaaaaattgtgtatgctccaattttatgcttgaaatataaaagaatcaaaattttgaataacacacaagtagatgtttttatttactttttaattttatggatacatagtaggtataaatatttatggggtacatgagatattttgacataggcatgcaatgcataataatgacataagagtaaatggtttcaatttagaaagatatttttgctggatacagaattctaggttgggagggacttttgctcttgttgctttttggcacagtcttgctttcattatttgtgataaaaagttagcaggatttctcatttttgtttctctttatctctgactgcatttaagagtttctcttaatgtattttcaacaatcttattataatgtgccttgatatgtttttcttagtgtttctcatgcttagggtttgtcaagatttttgatctacaggtatatttttattagaaaggggatcatgagttaaccagacatgagccatgcttgggaagctgttactgctcctgcggctacagacacaatggaaagaggtaaggtttccacatggacaatcacggcgggtttcctgacagaagcagggttcactgaaggtgggtgactgggagaaatactttggtttttccatacctgttcttccctaatcttctgtcagtacctcctatagtcagaatttaccctgtgatgaatagcagagcatgtgaaggctggaaacggagctcagagaaaatcagcagctgcccctcacaaaagcaacgtattctgatttcttcactgttggattcatgccatctggaagaacaactgggcatatatttgttgaatgaatgaatgaaatataactaaactcatgttttattattgagaaaattgaagctcctgcgggcttcacaatttactcaggtggttaagaactaggacttaaatttaggctatttcatattttaacatagcaatcacctctgacttctgtaaattgaatcatattttaaatccatatgagaactttctttccaaagacactctgtattgcgttttttgcaaaactgaaaatcctttatcacctttttaggtagatttttcaaatttcagtttctcttcaagctttctggactatttctttcgctgggaggttttacataacaactctattttaaaagaacagagcatttcaaaagggttatcattttggtaaaagagtcagcataatgtgaaagaaagagcatggtttttgataccagatagtactacattctgatctaggatttgcaagtaatagcaattagacattagagaaaacacttaactttcctggtccttgattccttattctgtgaactggggataataataccttctctaatcatgtcacagaactgtaagaatgaaattagatgatgcgtatgttatgcaaatacatttcttactattgcttagctgtgagtcaccttctctccagattagcttttattactgatactcattgtggacatagagtccagctgatagctggatgggtgggtatggctgaagcagaagcatagaatgtaagagacctgcaatagagacttcattgtctgatgagatctagtgagaacagcaacactcatagcaggtaaaagtgctgcaaaaagttggtaggaggcagtaagaaagtaactgagatgaatctacttattttgcatttcctatgctaatggtcatcttcattaataaagacaatccagtcactttaaaccagaggctggcatcacagtaaaaagggaccatttccattcttccagtatctatccttggcacttaaatccacgtgattttttaacagctttattgagatgtaattcacagaacacacaattcacccatttaagaacacagttcaatggcttttactgtatacacagagttatgcatctattgccatgatcaattttagaatcttttcactacccccaaaaggacctctcttgggtcccttagccattaccccttgagaaattcccccagccctggggagcccctcatttactttctgtctctatagacttgcttgttctggacgtattcacatgaatggaattatacaatatgtagtgttttgtagctggcctatttcgcttaacataatgtatttgaggttcaccatgttgtaacatgtatcagtactttatttctttttatagctacataatatttgctatatattttttcaagcattccacttcactgttatttgtttttccacttaatttacctgttctgatcatatgtaagatcaaaggagtccttgggtgttatgaattcaaccactgtttaatcttgaagagagaaagtctaaattgtcagagggtcctgagtcaaacactttcctgtgtgcaggaggacacggggccaggccctgccctctgactgtgcaccactggcttcctctaacaccgactccaaaatggtagaaattctcctccagataacatttaatcattataaaatgcttccttatcaaggaactcataatctgatcccaaatttgtattggtaaataggtaaaagagaactatatatttgaagcataaaatataattactggccaaaattctccagataattttaaaatagacatatcttacaatgagccccccagattgccttttaaaatgataatgtaaaatgtttgcctggtctcactgattacttggtaaattctgaatatgatgactttctgttcttacaatccataaacgcaacagctataaaagccacaagagtcttgatgacaatgaagaagcatttctgtgctgacaaagtcattctgctttagaactgtggatactataagccaacataagtcttctcttttcctccccatagcatgtcataaactttctgagaccatttgtaccaacgagacccagagcatgcatttatatgcaattgctgacgtttaaaatgcgataatttaataccagtactaacagaagctgcagaatcaagtgctattggtcctgctatttacactaaaatgggtaaccccagtgtgagtgacggcgaagtcctttcaaacccagaggttaaaatcttacttcctttcttacactccttttcatctttgcttcggtgtaaaatctgcatgacttattatgccattgttgaactgctctctgacctcattaacattcttatctcccagaaaaaaaaaaaatgttacaagagacctgtctggttattatctctgccacctaagacttaaagcttcactataatttccaaatacatctaccttgaaatatctaagcttacgtgtctcagctacttccccaagtatgctgaattctaacggtagagattcactaaacctattttctttttcacacttcataatccctggtacaggaaatggctcaaagcactaaatttgatttgtttttcaaaaaacaacaaagccataaaattctagaacagtaacactcaatcttaggatatacaacaggatacagctacagataagagctcttggtttattccggtgtttcaataggtatgaaattgatttttgcaaatagaaaattggcagattataattttacttgtggaacatttagcatattaattatgagtttgaaaattgcattttcgaatgatagtgagggcagcataagaactgtgaaaggataaaaggcatatctcgaaaaaattttaagacatataagtaagtatatcttcaataataatttaatgattgaaataatattacttattactgttttaggagcacttgatgtttctagtaacaccctggcagttctgtgctccttcccagatctttccatttctaccccaacttaaagaaaataacattacagctgaaatcaaagagaatttaagcatcatttggtttgagaattatctttctcactgggtggttgtcagacaacctaaacgcttggcttctttttttttttttctttgagacggagtctcgctctgtcgcccaggctggagtgcaggggtgcgatctcggctcactgcaaactccacctcccgggttcccgccattctcctgcctcagcctcccgaatagctgggaccacaggcgccccccaccacgcccggctaatttttttgtatttttagtagagacggggtttcaccctgttagccaggatggtctcgatctcctgacctcgtgatccgcccgcctcggcctcccaaagtgctgggattacaggtgtgagccaccgtgcccagccaacgcttggcttcttttatagcttcctccaaaagtgtgattcaagtcggtatgagggtagggtgtagggctgtttgctgagacagtgttgtccccaaactcacacacacaaacacacacatatacacctgtgtttacctatatatgcctgtgtatatgtgtaaacgtgtggatctctatctatagattcatctactgttggccaataggacataaaaaaacatccaagttttttttcattcttctgctctgctgggcggctgggggtcaggggaattgccgtttcttctcacaacagagacttattttcggtatctgtcctctacttcttcctcattaataaaaccctgcatttcagatggactcaaataaagatcacatccatttctccccttgaagtcagcgacagtaatgcatacaacttactatacctgttctttaaaaagggagcctagtcttctcttgctgtttcctgctggtaggaacacagacacacgtgtgcgtaaacacacacacacactgtgggagagatggagcagttcttgccccctcggactacagagtggaagctgcatgctcccagcctgcacatggcaagcatggaggttcctgaggcttgtggagctcctacagcctcactgggctcacttcacatgtaagtgttcaccaaacgtaggtaggcttctcatcaatattcactgggtcaatctccactttattctttgtgtctaagttcaaatcctcttaagctcttacctagggtttggtaatgatctcaaaattgttctttctctctccagatctctccctcccttattgtcttctgcctgctgttgccaaaatacaatttgtaatgtacaagtctgctcatagaaaataagtaacagaatcagaattctaacttatgtctatcttgatacagagctagaaatattagagacattgtggatagctaggaaaaaaaggagaaatttgacctaaaaagagggcacgtgttaaactcaaatgacagatgaaaggtatgcaagggctgagcatgccggagaagacgtgacggctatgttccctgtgttaggtcatgggtgagttattgcttgccattatttcatttgtacctttatatttagcatcatatctgaagcagcttttacacaacctggaattgctgtgaatgagcagccactaagaacgagtgcaggagatgagaagtgagtgacatttcccagcagttaaaaacccttcctgcacaaagccatgcctgactcacattcacccgtgaacatcattctctccctgtaaattctgcatgagaataatcctagggtttctcagttattaccatgaattgttcattagattgcgcacatggtgattttatctattgaacagttgaacctacttgaacaattctatacttctccataacaacccacggtgtaatatcacatttttaaaaaacactaaatgaatgagcttaattgagttgggtattttgtaattgaggaagaggcaaaatacattttttgaagagtaactccttgatgagagatgttaaatgattcatgaatccacatcagtgatggggctagataatgcagggttttcattcttagatcagaatccttagtctatcattagacccaccagatccaaaagataactttataaagtcaaagaaatgattttgtctacttgacttatagcctggatcatacaggaatattttgttttcatacatgaaaaatgatcatatttcctcactgatgttttacaatccaaactaaagcaaatccaaactaaagcaaaatcagatggttttacaatccaaactaaagcaaaacggtactttgagaataaagagttaaagacactgcctttatacaaataaaacaccatgtgtattaaaatatatgatccctaatgagatggtatttgaatgagaaaagctgggcatatcataattcttagcctagatatcgtaactgtgctttagaattggaccaagacactttcttactaagaactatctttagaagccattgtgtgcaaataacttctttctttaactagttggtggccttttattctgtgaggtatttaacatttaagtctgagtcacttgcttttaatgtgccacaatgatgtgatcccttaatatcgctgaactatgacagtgacatcctctttgaaaagaccaagctaccattagaaatgggtcatgaagcaaaagtcattaactcatttaaaaaaggccagagcccagcaccgcattactgacaaacctccttccctgtgtccatttgtctttatcaaatatcactttaatatccatctcccaagcatgagatagggttgtgaagcagctccctttgaaaaattaaaacccttagcaattaaatttgctttcaagtttcactttagatgagcaacttaattcttgtatgcaatattataaagtaagtattaataactcccagtaatacaaataatgattccagagttgctagtctgaaaacatttgaggactctttttttttgagacggagtcttgctctgtcacccaggctggagtgcagtggcttaatctcggctcactgccagctccgcctccggggttcatgccattctcctccctcagcctcccgagtagctgggactacaggcgcccaccaccacgcccagctaatttttttgtatttttagtagagatggggtttcaccgtgttagccaggatggtctcgatctcctgaccttgtgatctgcctgcctcggcctcccaaagtgctgggattacaggcgtgagccaccgcgcccagccttgaggactcttaaaagaggaaaattcaattaatagagtcaatgatgaaaaagtcaagacagagtttctaatattttccttgatgttagttttgcagaaagacaacatgagatagaggtcgtatcttttccacataccaaatgagaggtttattttaaaataatgttaaagtagtaacacaaatgatagggaataatatatgtcaacgtgagtgggcttcttgtactaacattttaagttttatatcagaatgagcttccaccttcagcattcaaatggaaatttctcacaacaaggaaagataatctatgctctaggaatccccttctggtagacaacctttgtagaatcaatttttacgtctgttttcctctgttatatctctcagaaaacaaaaagtttcatgaattttttcttctctgggctctcagctacagatgctgttgcaaaatgaggcaagagtgagttctgccaagagcaatgtccatcatgcaaaatgcctactacctaggagctttcagaagaagtaagacaaaggctgaacatagtagaagtttgtgtttctttccttcaactgaccccatgacaggaagcaggtggtggcagctgtttatccaataaaagtatttttgtttgttttgttttcttttgctttgaatggagtcgcctatcatctcagatctcagatatacctataaataaaattttaaaatttaaatattcaaatattttggccaacgtgcaacacaatccggttgctctttaaaagcagagataaagctattttataggcaaagcaaagcgcacagtcacaacagaacagcactggatgtttgcgttttacttattttatttttattttttattgatttttatttttgtttttttttacaagacggtactttcattattgaactttaaacatgaaagattacatttctacaaatataatagaacaaaaatgaatgtggagaaaaaaggaattatggtaactgtacagggcatgaaatgggcactttccgatgattgagcaagaaattaagtacagattataatacattctttttaaattcatttgacacattttatctttatttataacctattcttgtcttcattttcctcctccctcctcccttcctcttccccctttcttcctttgtctaccactctgatcttcatttttcatttcacttttttcttttttattaagcatttgtcatgtattttataaatctatactcctctgttacaataggtattagttattctgcagcagatcacctcagagggccccacgcaccccacaataatccctccacaaaccccctccacatttgtttctcagagctgaatctttaaggccacctgctgctgggggcaggcgccctccaatccggcagcttggatggagctgaagctgtccacgcggaggctcctgggcccctgacctggcctcacggtgtctccttcggctgctgctacatccttcctcctacctctgctgctgctgctgttctattatacgtccgaccttgacccagctctgttgcggtgttgacacctgtctgtcagcactcgttgaattttagaaaatgcttgacatattttctccatcctcttattttcagtctttctgagtattcctgttttcagtttctcttccagacaagatatttcttcatccaattcagggtgtcacgttcttttgtttaccttgggttttaatttgtgtaattagtattaaattagatcttatttttgacatctttattcacattttcaatttaggtgtaaattataattattattaaattaagggccaggtgtggtggctcacacctgtaatcccaaaactttggggggccgaggcaggggggatcacttgagatcaggagttcaagaccagcctggccaacatggtgaaaccccgtctgtactaaaaatacaaaaattaccaggcgtggtggtgcatgcctgtaatcccagctactcaggaagtgaggcgggagaattgcttgaacccgggaggtggaggttgcagtgagctgagattgcaccactgcactccagcctgggcaacagagcaagactccctctcaaaaataataataataataataataataataataataataataataattaattaaaacttatttctgccatctttttttttatttcttctctttcttcagacctttctaccccccttctttcctcctttcaataagataacttcacattttctctttctgatttaaaggtaacatctttctatttttataattatgattgtcatatttatgacccatactctttttattctgtccttattaatttcctaaatttatatatattcacatcttcctcctaacacaataaaaactagattgtttctaatatttattttgtcttgcctctagtgattatgttgttatttcctagggcttcagttttagattgctgtggatagacttttacttgttttcatccttctacttacctaacaaaaatgagttttactaagatatatatttatccttaatatctgttttttttttcttcaaaatgtgttttaaatgagggccattttatagttaaaagttctgaggccttttaaatgtatgaaaaaacatatgaaaatacttttataaagccttcatttttatgagtcagcttctctttagattcatagttctttttctttagtacattaaaaataaccctaaattttcctattatatttagtttgctactgagaagtcagctaatctgattgtttctttgcagatgatctttcttgctgacattctttaaattttcctgcctttgaattcttaattctcattataatatttaaatgcaaattgttccttatctttccatttttccttgataaactcttcaatttgaagtctttcaagtttctttaattctgaaaaatgtctattaattctccgcatttttccccttatcttttcacttttctctccttttgggactcatccaggtattgatatttattgtattctctatatctttcagtttttctattatgttttctctttctttattccctcaaggaattccttaatctgatctttaaactcacttatttactcttcagctgtaaacatcaaaatattccatctattatgttctttatatcagcaattatattttattatataatatttttcctatattctattttatgattatttcttattttatattgttaacatcttagattatcatcttaactatacttatcatccatttataaaattcttagtctacctgctctgacaattctcatttacaggatatatagtgactatttcatcttgtttctttatttcagctcataaaggtgtaagggccgtatttgtgccagtcttgggtaagtttgaggaaaaagctagggttaagataaaatgcagagagcccaggcattgtaggatccctctcatccaatgacattcctccaaacagtccttctgatcatggctgtacttcaaagtcttaagatgaagctctggccaggcgtgttggctcacacctgtaatcccagcactttgggaggccgaggcaggtggattgcctgagctcaggagttcgagaccagcctaggcaacatggtgaaaccccatctctactaaaatacaaaaaaaaaacaaaaaaataggcatggtggtgggcacctgtagtcccagctatttgggaggctgaggcaggagaattgcttgaacccaggaggcagaagttgcagtgagccaagattgagccactgcaccccagcctgggtgacagagccagactccatctccaaaaaaaaaaaaaagatgaagccccactcggaaagggcagcctctctaggatccggtccaccagccctgagtgctgtgagaggctagaggagtgaatgtctaagggcggctggtaggtccacatttttccaaagatttcccaaccttacaagacttttgatctgcttactataacttcagaacacatctgtaagaaactgggctattgttactttttgctattctggaggaattttttttaatgaattatgaaaacttttctacaatctattatgttgttctcttgccaaaactttcaaccatggttcaaaccaggaccatctacctagttttcccatccacatcaactcaagccagccttcagtctccctagggtggtttctctctcctctctccctccatctctcccttcctcattccctccctccatcccttctctctctctatgtctgtctgtctgtctctctctctcttcctggtatctttctccttgtatctacagtttgtcccacattgattttgggggactgcagcaatcagcagcctcagcttttcccagaggccttgctcatacctcccaggcctgaacacctaaagaacccatagctgctggacccaggagggatggttgaccagttgattggagttaggagggaagcacagttggaatgcgttctaactgccatatccctagaatcctttggtgtttaatatttagtgcaataattttcatgtagattgaatttaactaaagcaagtgtcatggctttgtcaggaatcttaatcatgaaactttccttggcttccagtatctatttgtggtaaatgttaacatgtacctgactaggtggctcctgttgaaagcaattgcaaaaataaaggcatagagaagtatgagtgaaggtctggattacactttctttcaaataagaattcagcatgcattcttttttccagagatcttaattcaagatccataatattgcatctttctcttttcttctaaaccacagggtaaatgagccctaaaataattgtgggttctgaatcttcactggattctacttatgtcacctgtctcttcaattctctaactacaccctccagacacaacctctgaataagtgtccccaagcacctgacactctcacttccacgcctttgcagattccttccggcatggaatactccgcacttctcatcttattctcttgttctgcctattctctgctcatgctgaagaggcttcttggcgccttttcactaagacgattggtgacgaggccttctcctggaagcatgacatcactcacctctcccagccgacgccatgctcaagtctccttgcatgagaccatcatactctggtttggattttgtaatttttatttgactttttctgccactggaatatagggtctttgagatcaggactctatgtcctagacatttttacactcaaccttagccccagttagcttttagacaagtaattattgaatggcagtaaatattccttgggtttcactgaagtctgctctaaatgcagttgagtttaatgatcaagagcttggactctagcatcaaatgtgagttcagattatttctccattacctcctagttgactaacacctactttctgactataacaacaaatgttactgataactatttctaggaaattcattaataacatatctattatgtagtaacttatcaataaagacaagctgttgtaatttgatcaggtcaacttcctttcattaaaaaaaaggtgaaattaactaaatttatctttggtatgcccaaaaccactctcccatctctccagtaacttctctgtgtctttatgtgactcgggacacttctttgtcaggagataaaatactttgatgaggagatttacataaaggcgtaagtaagaacgacttaaaaaattatctttgataacatagttgctgctaatccaaaggagaaactttaatgctggaatggcaggcattaacaataaataaaccgctggaagtaattttgaacgggatggcctatgggaaacatcctagaaatcttactatgtaaggaatctacttactcatttattcactaagttgaaaaattcatactgaattcttgctgtgggaaatatttttctgggtgtgtagaaatgtagagatttatattacttacttttatcctcaaacgtgctcataatctaacaaagcagacaataatatcttgtatttatattgttttacatatatttacttataataactatcttgtgatgaaggttaagaatttcattcccagtgttcaggtttggaaaaggaattggatttacccaaggtgatacagctagaaagaggagaaatctatactcatatgcagttctcctgaatataactatttttcccccatgacacaatgcctatacaaccataatccaaataaactgataggtatcataagtgccaaagtaatacatttagatgagagtaaaattaatgtttgcaattaattagtaatggtctcatacatagggcatttcagtgcgtgggcactgaagaatgaactggattttgacaggtggagatggtggaaaggacattccagactggaaaactggagaaaaaataggaagtgcacaacagaggtgggaaagaacagatcttttttttttttttttttttttgagaccgagtctcgctctgtcgcccaggctggagtgcagtggcgtgatcttggctcactgcaagctctgcctcctgggttcacaccattctcctgcctcagcctcccgaatagctgggatgacaggtgcacgccaccacacccagttaattttgcttttgtatttttagtagagacaggggttcaccatgttaaccagggtgatctcgatctcctgacctcatgatccacctgcctcggcctcccaaagtgctgggattacatgcatgagccaccatgcccagcctagaacagatcatattgtaggaaggccaaccaccctggctgactagaatatggggtatgtgaaagaaagaagtggttttgataatatttaaaatatagattggaactagattatagagaattgtaagttttcactcttttccaaagccagtagtactcaggcctggctcagaatcagagtcgattttgcagcttttttttgaaatgcccacgccttggcagcactcccagagatcctattcattagctctcaggtgcatggacatctgcatattttaagattcctctattgatcctgccctgtaggtacagtagagggtccgcgtcatggtgattgaagcgcggtccacttggcgtgtggtctgtagactgtgctagttttcaaaggattagtgcccatgaagagaaattgaatagtgaaagggtaaaaactgtatagcagtttgatgaagtaattttatatctgttgagacacagaacttaaaaatggcaatgtgttttatatgtgttttgttcattcttgcacaattcatcttattatattttacaaagatattgttacctgagaattggaaattaaaaacaaaaacaaaactgggtttttcacacagataatccaggaagtgtcatcactccaggccacggtggcattcgtgaatgggaaacaatgtttggaaagtgtgccgttttgacatcagtgtggctctggcacgttggatggatgagatgagtaggaatcagtgtgaagtccgcattacaacatgcttggattcagttatgccaatggtaatggaaagaaagaggaaagatttcagagaagtatgcaaagaaaaaaaagaaacaaactgtcaatagatagaataaaagaaaagataaaatctaaaaatgttcttgatgtttcatgcctgcgtgactgaaaaaaaaagtgctactatttagaagtatgtagatatcattaagaacatttgggggcaaaaagggggtggaagtgagggtggagacagtgattttagctctaggcacattcagtttaagaagtctgaagtaaggccgggctcagtggctcacgactgtaatcccagcactttgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtctgaagtaagtcaaatggaaatgtttccaaagccggtgaacatatgggccctggaacagtgacagtcacagcagttgggatcataatcaggggtggtattaaggacatattcaaagtggccagtggagcacagcactgacagccccgaaggcacagtggccataaatgcacgacgttgccaagggagtgcctgcccactgaagggcagccctggctagaggtgggataaccctggataagagtgggcagggagggggatctctgagggagagatgatagagaaagcaaagagattgtaaaataactcttagtgaaagtgagaggagaaaggggatgtgggaaatgtggaagaatgatataaagttggttttctttctttcttttttttttttttagacagagtctcgctgttgttgcccaggctggagtgcaaacctccgcttcccgggttccagcaattctcctgcctcagcctcccgagtagtggagattacaggcgcccgccaccatgcccagctaatttttgtatttttagaggagacggggtttctccatgttggccagactggtctcaaactcctgacctcaggtgatccacccgactcggcctcccaaagtgctgggattacaggtgtgagccaccatgcccagccagttttctcttgaaatcaggaagagaagaaattttaaaatgaaaagaacaagatgacaaacattgatgaaccatacagagaaatggaagagaatgagaaataagtaaagactagatttagggagcaaaaataaacaggaaagcttgaagaaatcagctttagtatgttaggaaaaatttaagatatagagcaatgaatagcaatatttggtaaatgctaccggctggattgtgacgccctaaaacccatatgttggagccctcattccaatgtgatggaatttggaaaagggaccttggggaggtaattaggtcatgaaggtagagccctcatgagaagatgagtgtccttactgattttatttttatagatttaggaggtgaaagtgcaggtttcttacaggcatatactgtgtactggtgaagtctgggcatttagtgtactcatcacctgagcaggaaacactgtacacaacagttaattttcaaccctcacccccctcccaccttccagcttttgtagtctccaatatctaattttccattctgtatgtttttgtgtacacattgtttagttcccactaataagtgagaatgtgctgtttctgatttattttacttaggataatggcctccagttccatccatgttgctgcaagacataattctattctttttttttattattatttttgagacggagtctggctctgtcgcccaggctggagtgcagtggtgcgatctcggctcactgcaagctctgcctcccgggttcacgccattctcctgcctcagcctcccgagtaactgggactacaggcgcccgccaccacgaccggctaattttttgtatttttaatagagatgaggtttcactgtgttggccagaatcgtctcaatctcctgacttcatgatccacccgcctcagcctcccaaagtgctgggattacaggtgtgagccactgcaatcagccgattttattctttttatgttcacgtagtattacaaggaatatatatgccacatcttctttatgcagtcgtctgttaatggactcttagtttgattccatatgtttgctattgtgaatagtgttgtgataaacacaggagtgcaggtgtcttttggatgtaatgatttatttccctttgggtagatacccagtagtcagattgctagattgaatggtagttctttttttagttctctgagaaatctctgtactgttgttcagaaaggttgaactaatttacatttccaaaaacaatgtatatgtgttccctttttcttgcatcctcaccaacatctgttgtttttagactttttaataataggcattttctctggtgtaagatggtatattcttgtggttttaatttgcatttatctgatgattagtgatgttgagaatttgcttatatttttcttgaccatttgtatgtcttcttttgaaaaaatgtcttttcatgtctttcccccactttttaatggggttgtttttgccttgttgagttgtctgaattccttgtagattctggatattagcctttggtcaaatgcatagctcacaaatattttttaccattctgtagattatctgtttattgattgtttcttttgctgtgcagaagcaaatacaaaacactgatgaaaggaatcatggatgacacaaacaatagaaaaacattccatgcttatggattggaagaatcaatatcattaaaatgaccatactgcctaaagtaatctacagattcaacacaattcctatcaaattaccaacatcatttttcagaattagaaaaaaaaatcctaaaattcatatggaaccaaaaaagagcccaaatagccaaagaagttctaagcagaatgagcacagctggaagtatcacatcatctgatctcaaagtatactacaaactacagaaactaaaacagcatggtactggtgtaaaaatagacatgaagaacactgaaacacaatagagaatccgcaaataaagccacattcctacaaataactgatctttgacaaaatcaacaaaaatatacactggagaaaggacaccctattcaataaatggtactgggaaaattggagagctgtatgcagaagaatggagctggatccatacctctcaccatatactaaaattaactcaagacagattaaagacctgaatgtaaaaccaaaaactataaagatcctagaagaaaacctacgaaaaattcttctggacgttggcctagcaaagaatttataaccaagttctcaaacgtaaatgcaacaacaacaaagacaaatgggactaaattagattaatgtctttaaaagacaaataggaggctgtcatctgcaagccaggaagaagtcccttaccaagaactaaatctgcaggcacccagatcatggggcttcctagcccccagaatggtaagaaaaattttctgttttacaagccacccaagctatgacattttgttatggcagcccaagcaaggaatgacactaaagaagtggaggcagtgaatataaagtcttcacaatgctaccaaataaatgaaagaaaaggtaagattgtcgtttaagaagggtgaagaaaacaaaggcagtatttgaagagtgagtggctgaaaattattcagaaatgatgaaagacatcaattcagagatactggaatcccaagaaatatcaaacaaaataaataatatatattcaatccattttaatgaaactgctgaacatcaaatacatggaaatcttaaaagtactcagagatagcaggcatgtaacttgctacgtaaactgaaaacagatttttcaacagaaacagggcaagctggaaaatcgtagaatcatattttcaaaatgctaacagaaaactcagaaattcatttccagcaaaaatcttccaatgggaatgaaggcaaaataaagacattttcagacacacagaacagagcttgtcactaaatacaattttctggcagaaggaaaataatcccagttagaaagttgtgaatatagaagggaataaaatatgacaagactggtaaatatgtgaaaaatttaaataaagatcaactacattaacttggcccaggctggagtgcagtggcacgatctcagctcactgcaacctccacctcccaggttcaagtgattctcctgcctcagcctcccgagtagctggtattacaggcacatgccaccacatccggctacttttttttttttttttgtatttttagtagagatgaggtttcaccgtgttagccagatgatctggatctcctgatctcgtgatctgcctgcctcagcctcccaaagtgctgggattacaggtgtgagccaccacacctggccaaaacttatgtcttgtagagtttaagatatggaaagtaagtgacaacactgtgtaagtcacagagcagtaaaagaagttggaatattttaccacagttgcaaaaaggagagggtttgtgaggcccgggcttctttatatacaagaaaaggcaacactgccaaatccgagtctaggcgcccagaaagctaatgcaaaaccagtgcctaaaggaggaaagtatcaatgtcaccttgaaagtgaacagagacactactgttattaaaaagaaaaacaagtcatgaggaagaagaatgtattgagtcgttagcatgctcaaggaggtttccacatattaatattatcttaatttatgttatttattcctgttatattctaatactatgtattattatttatgctaatactatgtattattatctcctttttccaaggaggaaactgactctgtagggtgagctaactcatcctgaatcaaagctgcaatgtggagattggtgtgttccattacatctcattgcccctttagaagcaggctgtgctggggaccaggaggaggccattggatgggtgccaggaagctcagggcttcaggcatggctgaccctgtttccactgggccccagggaaattgaagccaaatgtatgaggatggaacagttctgaggctttcataagttattttctgtaatccattgaccattttgatgatcatttttcctcccagaaaaattcacttaccccttttctcttctgtggactgcattgccacattttcctctctcatttgatttcacaagtgtccataatcttacttgctcctttcctttggcattttctcttggaatctaagtatctctgttttttatattttatagtcacttgcttcatgtttatcctctttttgttttctatctctttctttccccaaagaaataagtctttgctgcaattcataggggctgatattgaaccatacgtccagggtattactttacaatgtccataagctcccagaaatgcaccagaaatacgccaacaattaaatgacactttatttctgggcgtaggtaggggttcttgctgcccaagcacagcctggcagacagaggcaggacttcaaatgaccactgcaagcctctctttttgacggatgcagctcatccaatacaccaagagaaggattgtccaaattaaaatctatttctaacaggaacccatcaggaacaatccctaatactgttcttccatgaagaataaaaaaggtaaaagtcatataaaagagggaagacatggcaagatagttacaagaatattttcagagtataagttttaggaaatatgctgaattatccagtgttttaattaccctgaagctggactttccaaccaaaactcataatctaattaaggaagtccatcatatcaacagcacataaagcaacaagcaattaacattttccaaaaatgaaactgatgcaggagcatttcgatttactctaattatactgtgaatgctgtgcctaatgcaacaatgcctttgcatttaaaaaattgtctttaaaggtctccctccaaattgtaataggcttatatttctcccattctagctgcctgtaatatacataaaaatgagaattacaaagaattctcaactcatggatattataaaatatagatgacagaaacttggccctgaatgctcccacaagaacagtttgcagcaatcacactacaaagagttgtaaggatagcactttgatcaatctgcttcattcatctctatgcgcttgaaagaaatgtcttggaaagggctaagagccagcgttcctgaacctccgaatacaggcttgttcttgcaccagatatcgtgcctaccgcagtgcagagctcgctaagccttcaggaagcttttgtttcagaccacagtggtgtgcactcctctaaagcatatgctgcagtacatgactgagccttctgtcagctgatgaactgcatctgactcctggtgtttaaagggtctgaaacaagcatatcattctgcaaagtctgagattcaaaataagtaaatcctattgattatatcagtagaaattacaatcatgggattctagaagtacagggaaactggaggaaactccagatgaagaagctgacatccaggaaataaatagttgcccactcctacacaaagtgggaaacaaattggctttattgactcctaaacttttggaatcagaaagatctggcttcagattcaacttttccatttaatgtgggaatgtgagcgagttacttccctagccctttggtttcgtggtctttaaaatggaaacagtaatacagaccccttacaacatgaagatcagatgaaatgacacatggggaacctttgatgttcccactgttctgagctgcaggctctctgaagtgatcttcttccttctcatgtcattttctgaggtaataaaaagcagatgtgaagtaaaaatttgtcagataattaatcaagaagaaaaaccagagcaggcaggaccttcagatattcaaaatcataaagttgacattttatctaaattcctcaagttggcttttcatagaagctatataactggtgtttcacactgcacgtcatgtttttaccgaaataagaggaagattacatccctaaatacaaatttactaccaaatcatgacgtgagaataggagaaatagctccgtgggacattagccaagaaccgtgataaataagaagagagaagaaggttgggtgctaagttagatgataaagttaccatgattttctagctaataattatcctacattctcagatgcctgaagaaagatacatgtgtttgtgtgtatatatatatatgtgtgtgtgtgtgtatatatggcatgcaacaccataaattaattagatgtgccttgtatcacatagcttgaattaagaccatagaaaagataacagaagtaagaatttaaaaataggacccaatataaatatctatttgatttatgagtgcatttattaattcatatatttattgatacttcctctgtgaataactgtgcaagttttagaaatataaaaatgcagctggtgcagtggcttacacctgtaatcccagcactttgggaggccaaagtgagtggatcatgaggtcaagagatcgagaccatcctggccaacatggtgaaaccccatctctactaaaactacaaaattagctgggtgtggtggcgggtgcctgtagtcccagctactcaggaggctgaggcaggagaatcgcttgaacctgggaggtggaggttggctccactgcactgcagcctgggcaacagagcaagactccatctcaaaaaacaacaaaaaaaagaaatataaaactgaattaaatatgatcccagccatcaaagaatgcacaattctagaataacaaagcataagcttatagcactggcatggtttcctgctgagtctatagagcctgcttccaatgttatcatgccactgtcaaaagacatacaaaattaaacaatattttaaagagcaaaaaacctctgtgtctcaaactccaacaaatactatttctacaggacatacaagttttcaaatgctttgagttagcctttcacaataaattattttccaaaaaaatgatttttaatgtgtaaaaatttttctgctgtgagaaaaaataaaatattgtttaaaatcttaatactttaacactttacaatactttatatattattttatataattgtcctcatagagtatatgtaagtttgtgtcatgtattatatgcctagtgttacatcctaaacatgtccccagtggtaaccactgtttgtttttatggcagcactgtattaaatttaagtaataatttactgaataatgtctgtattgttggatatttagaatttttctgctttgtgatcataataaacaatgtaattggtacagggctttaaaatgtgataattatttagaccatcactgaagtcccaaaatactagctaccatattccaaagttaagtcaagaaaccatgaagggccgggcgcaggggctcatgcctgtaatcgcagcatttcggaggccgaggtgggtggatcacatgaggtcaggagttcgagaccagcctggccaacatggtgaaaccccgtctctcctaaaaatacaaaaattagcagggcgtggtggcgcttgcctgtaatctcagctactcgggaggctgaggcaggagaatcgctggaaactgggaggtggaggttgtgagtgagattgcgccactgcactccagcctgggtgacacagcaagactctgtctcaaaaaaaagagaaagaaagagagaaagaaagaaaggaaggaaggaaggaaggaaggaaggaaggaaggaaggaaggaaggaagaaagaaagaaagaaagaaagaaagaaagaaagaaagaaagaaagaaagaaagaaagggagaaagagagaaagaaagaggagggaaggagggaaggagggaaggagccatgaaggacctgtgcagatattgggaaaaactgtgttaagccgggtcatatccctgccccccacgaatgcttcctcctcatctcaagtgacgtaaggcgatttccaagagcatgctatgaggctctgggaatttggaacctcgtggcctggtctggctcagacaagagaaatgtaaaacacaggagaccttggctggcaaggagaggttactgcattgttggacaaaggatgtgtggcaattgtctcaaatactgtctaaaacacgtcagaaagagaaagacttcccagatgcctcaaagattagcgaaattaccagcaacctgttaaaaaagaagtctcaccaatattaagagaacgctaagtaaaagatccctggaaatacggtcttcaaagaacccatgtgagcatccaggagggacgtgttggcttaaatacctgccagaccaaaggagcgcctgtcccttctcattccaatcagtgaagtgaaacatggcagcctcctttaagtgaatgtatgtagtgtgtaaggggtcggagagggaagccacaaaagcaaaggagggaaaaacagaggggaaatcttcctccctcccatcacaggactgaggctgaggagacaagaaagaatctttttaaataaatatgaagctgtaatcactctactagagtaaagaaactaatttgtaagtgattcttctttgtttttctaaccataagcatcagtaggactcttcactatctaagaatgagttgggggaccacgagatctgagctccttgtcatccaggaagatgggaggaatgagttttacagaatggttgtaacaagaagtcagcagatagcaagctgatacctgataccgtaccaagagtcttgcttttccaacataacagtcagactataatacagattacaatttgtaatcccagcattttgggaggccaaggcaggaggatcccttgagcccagcaggtcgaggctgcagtgtgctatgatcacactgttgcactccagcctgggcaacagagtgagaccctgtctcttaaaaaagagagaaaaagaaaaaaagaaaagaaaattatgttgcaattacattttgcattcttttagtatatctcctttggataaatcctcagaagtgagattgctagggatttcatgcaggtgccatcatttacttaatcaaaccctatttgcaaacaatctaggagtttttccttcattttttatgatgatcaatgatgttgaaatggatgtaattttatgtaacagatttttcctccttttgggctatttactgtttatgtgtgacccatgggtggaaattgtttttgctcttgatgcatttacaaatggctctctaaagggattgttcccccttcattattaccagtggtgtgtgaacatccattttactagaactagatattatttaaatacaaattaataaatataaaatatcaatcttttaaatttgaatctcttctttcactaaaaatattatcccattcacttaccatttacaatttctcctttgtggagtggtttatatttttgtcaatttatcccaaagggattttctgattatagactgctcatgttctcaccccaggctctccagctgcatctgtaccagcagggggaaaaggaataaaataggtgataatataatcataaatatttgcaggaatcctgctgtccaagtttcctactactctgggcattcacatttatttatttatttattatttattttagacaaggtttggctctgtcacccaggctggagtgaagtgccacgatcttggctcactgcaacatttgccttctgggctcaggtgatccttctgcatcagtctcctgagtagctggaactacaggtgcatgccaccatacctggctaattgtgtgtgtgtgtgtgtgtgtgcgtgtgtgtgtgtgtatgtgtgtacagaaggggtctcaccatgttgcccagggtgggttcaaactcctggactcaagcgatccacccaccttggccttccaaagtgctgggattacaggcacgagccaccacatttaattcttaataaagacaatggaatttctaggaagaacttcctcttacgaaaggagctaatttgttttcttttgcaagatatgttgtatttatcattataacttagatcaaatgaaaaaaataacaagggaattttgcatctttttggtaaaaaaatctgataagtttcagcaatattaagattactgtaaaggcttctcttcacaaagagtctaaataggacattgaatagcttcttaaccaaaatgaagtaaaatttgagtaactaaagtaaaataaaatttttcatgtctgagccagaccaggccacgtggctccaaattcccagaacctcatagcatgcgcttggaaattgccttccgtcacttgagatgaggaagcattcatggggggcaggggtatgatctggcttctgacagctttttcccaatatctgcttctcttgccctcatctccaaaagcctcagacctttggctcacaagcccttcatggtctccttctttcttcttcttcttcttttttttttttttttgagtaaaagaacactaaaacagcaagaaaatttttctgtagttatcagaaatttcgctgttatgcggatagctttgtttttcattattaaacataattttgtgtttcttctaaaagaaattatattttgcatctaaacgatagccacaacaaaatcattagaaagatattatacaaccatatccaagtaggataaatagttgttgtagaaatcacaaagcagaaatacgttatcacaatcagtgaatttgatttgaattttagataatcatatatttctacccaaatgaatcttgcatttatatctatgtgacagctgccaaattggcctggaatggaatttggctgatgtaatttacaacagttcatctatttggtttaaacaaatagcaaagaccaggaataccagagttgggacatacctgatttacaaagagcaatcagacgaatcggtgttttcattctactcagatctacccaggttgtgtcactttaggttaggacacagtcgtggagattttgtctttaactgctatgcggttttggttgtgagaagccaatcaccttagaactggcttctgccactttttggagggaaacatcagaaaaaagggcaaagtagagttttctctccttggctttctttggttattaagagctccccaccctctctctagtatttgtgatgctgcttctgtccctctacttaatcctattgaagctcacatcacactctagcctggcatcatttttgtgagtcttagagataaaaatggtactggagtattacttaataaaatccacccacttttctaaatacaaacaaaacaaactgacaaatgaatagaacaattacttagcaaccaatgggtggaggatgacctcctgacaaagggtgggtaccaacagtatttaacctgcagcatatacttagcagaaaacatcagaagcctgcttgttaaatatcccagcaacaagacacaaatactccctatcactggtactattcaaaactgtagagaaagtcctgccaaaaatatacaagctaaacgtgagtgataggattactggaaacaacgaaaaaagaaattctacctagaaaagccaaaaaaaaatcaactgacaaactggtaagtcactttagccagctcaaaatataaaataaaagcaggacaaaatcagtaacatcagcactaggctacttgaaaatataacttaaaatgttcaattacactagcaacacacttatctacataggaagatacctaattagaaaagggtgagtcctgtatgaaaaaaacataaaattgaatttaagaacataaaagaaagtgaaaacagacctacatcctacgccaggttaagagagttccatataatagaaaagtttttaattcctaaattaataaattctgttcaatttttaaagataagcatgtttccaagaaacactaccattcaaagcttcatctggaagagtgaatttaaaaacatagacaaaggaattttttttttttgagatggagtctcgcactgtcgcccaggctggagtgcagttgcgccatctcggctcactgcaacccctgccccctgggttcaaacaattctcctgcctcagcctcccaagtagctgggattacaggcacccgccaccttgcccagctaattttttgtgtttttagtagagatggggtttcattatgttggtcaggctggtcttgaactcctgacctcatgtgatccacccacctcggcctcccaaagtgctgggattacaggtgtgagccaccacacctggccaacaaaggaattttttaaaaagaacaagactgtgaggtgaagctaaagaactagcccttaacaacataaaaacataccataaagttgtaataattcagttaatctccattactgttttaagtgaggatttggcataagaaaggaaaaaatcaatctgtgaaacagaataggaaatatagaaactgacccatgtgtataactcatgtgcagaatgataaaggtaaatcattcaaaattgtaggaaaaggatggataggaaaatacaataaaaatagaatttgaaaacctatttatccatttgtggggtaaaaataactttacagctcacatgtcatatattccagattcagtaaaaccataatattattgtaaaaaatagaataattttcagaatatggaaggccttgtaagtaataactgggaaaaaaacaataatgggaaagacagacaagtttggctacatagaatgtaaatttttgtataataataataataaaagtaatataaatagaagtcaagagacagactgggagaaactcttccacttagaaaacatacaaagacaataccacacattggtgaagaaaggatgtagactgcgtttgtctgactgtctgactttgtgcccagctctgccaccaactgtgaccttgggcaaggtcattgtcatcaatttgtttaatatagttgctgctttggcatccattcctaagccagacattttatatatatatatatatatatatatatatatatatatatatatatatattcccccccagacggagtttcgcttatgtcgaccaggctggagtaggagtacaatggggcaatcttggctcaccgcaacctctgcctcctagattcaggcgattctcctgcctcagcctcccgagtagctgggattacaggcgtgcgccaccacacctaattttgggatttttttttttttaagtagagacggagttttatcatgttggtcaggctggtcttgaactcctgacctcaggggatccacccaccctggcctcccaaagtgctgggattacaggcgtgagccaccttgctcagccgttaatatattttttgaagctcagccgcaccccatcacctttgtcctagttaaacctcccctcgcgtgtgagtagttgtgatacagcctgcttcttcctcatctcactgacctgaaacccagcacaccccacggctgctggtggtggtgaagcctcctggtcagcaccagaaactataacaaagttcctcgctttgccgtggtttctttacagtcgcccatccacacctgcacagggaaggcctaggggaaaacacccatggaccccaataaaggcacagcccccaagtcctccctctctcagtcagccgcaccttctgcttgagcctgtgtccctgacagccctgactgctccccgcttcctgctggccccgtaaggtctgctgccctcccgccgcggggtctgtgagtaataaaactgctctgttctggatttcgctgtactgcctccactgtgtctcacctggccgactcacctgaacccagcttctttctccgtcaagactctcctagagatcggccatcctggtaggaataaactgcacacaggtcaggcaagagccacagggtgtctgccagtatcaacaagcttcttgtggaagggaggcctggtcacaggttggacatttaggcagtaggctgtctgccagaatgaagtcgttagtaaaaggcacactgtcaacatccgtgaccaaatgcccaggaatctcatcagggcagggctaaagtttgtagccactctgctgagagagacctccagacgaaatgagaagctacgtgcgcgcacacacacacacacacacacacacacaccccagtctttcagctctctgtgtctcaattcccttatttgtaaaatggggacagatgtgccggctcactgtactgaaagaatgaaatgcagtcatctataaaaagtgcttagagcagtaccaggactcaattaccattgggtgttattattattatatacaaccaaaaacatctagaatatttgactatgcgaaaaactcctaaaattagttttagaagtataaacaatacaatttacaaatgagcaaaaaataaagacaggcaactcacaaaagaaacatgaatagccaataaatagaaaccaaaaattttcaaccacaatgataatcaaagaaatgcaaattaaaatatcagtaagatgccaacctgcatgcatcaggttagaaaacgtatgggataactatggcgatggatacgacaacaccatagtcagacagcctgttgacaggcaggcagtcattcctaccagtgttggtgaatacaaacccatgcattcttttggggggtgaatttggtagaatattataaaatgtaaaatgtaaacactctttcatctaacagctccaatccttgagtctgcactagagaaatactctaaacaggtattgttcatcactgagaaggtaggacagcctctaaatgccctacttacaatactgtaagataattagtagttcatggttcaatgcaacgatgcatatctgtacatattgccaagaaattttcagtcatactgttgttattttttaaattgaagaacaatatataaaaactggtcccatatatattttaaagcccacaataaaaaatagtatataatatagaatttacacatataaacatatgtggcatataaaacatatttatagaacatatgtaaaatcatatgtatcatatgtaaatgaagagcaacagtgatcaattctaaggggaaggcatatgggtaggggattggaggaacagagatttatcaaggttgaattttgtttgctgtgtattgactgaattatttacaataaggatgcattcacttacggattgtgaaattttaaaattaaaaaaaaagacctgacatataggtaatattcagtaaataattgctgttattgtagatgtgaatgtaattattaatcttgaaattatgtattagtctcttgctcttttttttttgagatggagttttgctcttgttgcccaggctggagtgcaatagcatgatctcggctcactgcaaccctcgcctctcgagttcaagtgattctcctgcctcagcctcccaagtagctgagattacaggtgcacaccaccatatccagctaatttttgtatttttagtagagacggggtttcaccatgttggtcaggctggtctcgaactcctgacctcatgtgatccacccgcctcgacctcccaaaatgctgggattacaggcatgaaccaccacgcccagccatctcttgatcttaaggcaccaagagtctgcttttctgacaaccagaatgccactgtactattatttttttttaagctgaagtcttcaaaccagtttcatacaaccaaagcaaagaggaagcctacagagtttcataaagtgaccaggaacagctgtctggattgattcgaaatgaaagaaaagctcgaacttccactgcagcaatcttgtacagcactttacttcggtagacctgacccaagcagcacagagcccggcatttgcaaaggggagtatactttcagacataatgggaaagaagagaattagcattttaagggttgtgtcttttttgctttatttattcatgctttattttcatctttttaaataaatcacattaataggctatatctgtgtagcagacagaaatgtaatttatttgagaaaggcaaaaataaattgccattggtttttaattttgattgttaataagatgatacagttaatactgatttaaaacgcctgcaaacaagctctgcagaattcaaattatttatagataaaacgttaaatattctataacaagcttgtatcacagaaacatcagtaattttgggtctgccttgcagcttatgtcacagaaacctgtctttttttggtgtgtccttcagttattagatataaggtcaacagtctcatgtattatacttaatgcgatggttgtgtccaattcatctctttatcacctaatgataattcttattaatgtaagttatttggaatagatggagtcaggccaatcacaaaatcccttgactgtagttttgaaatatgctcaacatcataatgatggaaagtcatatttggaaactctgagggtatcttcaacttggaagttaacttctttaagtaaattaggattgtccttggcagatggtgaaggacctcactaaatgaaacacataattagttttacactgacataaatatatctccttatgcctgtatttgttcattttaaaaatgagatttgattagatgatctaatcctatctttcagttacaaaagaatgtatatacacatatatgctctcctatagatatcataccatataaaattagaacaattgtaaattatttctaaagaagaaaataaaatataggtctaactctgatgaaatttcagaacagatcatcaaagatgtgttccattagtacttggcaaatgaaaataaaatgatagtaaatgtaataatagtgattagcatgggttgcatgagaaattttatcaaacaatactaatcagtaaatacgacatgccttcgggttgttatcaagatattttttataagaagattgaaaagtttcaataacaaggtcttcttgtggcttgtagaataaaaaggattgattatttgtccattatcaggctgaaagaggatatctgttttcttctgaagtttttgtccatggccccgactcagtgcacactttttttagatcaataacttgaagatatagagagtatcaagtttacaaatcatttaaatcaaagaggcatggctaactgtacatctagtagcaaaaatatgattccaaaagtttaataggctgaaaacatgagattaaaactaaaacagcaagatgggagctggaggcagtggcagacacctgtagtttcagctactctggaggctgagactggaggacagcttgaggccaggagttggagactgcagtgagctatgattacgcctgtgaatagccacagcaccccagcgtggacaacaaagggtgaccctgtctctaacaaaagaaaaggcaaaaactgagcaagatgaaatgtagaaaggataaaataaatagaaaacccaaattaccgatattcgctgtgaataagacatagaagtttatttgttcacagtgagctcaatatgagccagtggtgtgattggttgtgtttcttccttctgaaaatgactgcagtttaaactaaactattagtgttcaacacacacaaaaatatagtggcacttggttagtttatgtctagaaatccatgtttagttctggttaccgtatttaaaatatttggttacctttttagttctggttactatatttaaaagcagattacagacatgcgtagacaaaaggtagttttaaatatggtaatgatattgggaagtgtgtaataggaagccaaatgtttttagcctagaaatgtaaggtgtatgcatttgtgttagggtgcacgcttttagagagggtgactattatgattgggaggggaaataaagagatgccattactatgcaaatatttataggactatgtcttagaaaacacatttgtcttacatttatctttttactctgctttatatttttaatagatgtttaaaaagaaaattaaaattattcttcacagtcaccatttttgaaaagacaaaagtagcaaaaagagagataccagctcatgcaaactaaataaaacaaaagtgttcctgtttctccacgtgtgtccatctttatgtactcagtgtcaaatatactggcaggcagacagcagatgttacatatgtactggccaaatgaatgaataataaatcactatgaagtgaatggcttgtgagagcccagccactaggcaagcctggaggatgaccatctatgagggacctcagagaaagaactgctgaaagaagcccatgggcctccttgacttctaagatacatttagacataatactatttaagagagcaagtaagagcaaattttctcccatagttctgattatcattatagtttaagcgttagaccttgttcaaacaagcttggaaaacaagctgtcttgtctgttaaggggagagtaagtgatataaaaatgtaaaggttaagatttctgataagttaaagcttggtaaaatatttccacgtatgtaaatgattatgccaatttaatttgtttccaaaattggaatatcctttagaatagaaataaaatatttaatctgaatggtaatacactgatctccttttgtcgtgaactaccgagtcctttctacagttttggccatacacatgaaaattaaattacagtattttaaaatagtatttgtatattccatttgggatcctaacttacctaagcagctcgaatacattttaaattaaaatcaagtttggatttttttcccagagaggtgacttattgcaaataagtagctccctctatttcatatttgtccatttttattctaaatattttaatactataacttaaatattctattggttttatttttcttaatatgataatatttttataaagtatttaaagtaaacaaaatgtattatagttattgttagataaaggtgatagacttaaataaactaaggcatgagccatatctggggttcatggatattgaaataatttattcttttaaagcacattattgagatgttacacacatttggaaacacaaagggtaataactttagtttctatcgataataaaaattagataacctgaggaatctttagaagagcatagcaatgtaaaaaaaaaaaagaggctaaaataacacacatacgttttaacagtgtttgtcttttgctggtgggactatgaatgatttttctccccactgtctacatttttacaattaacattattttaacaagaaataaaaatggcgtgttactttcttttaaaaaaaattgttaaatgttaagagtaaaataatggcactacactatttcaaaagcaaaatattaatttcatgttgagcataaaattcttattaaggctgagtctctttgtgtcatactaataaaaaattctccaattatatatcttaagggtacctgggcagagcaaccctcaacatcactaggaaatgaatcccttcttggaactaaattctccaaatcagggaagtcactttcttaagcaataaaatatttggaaaattaaacttatttataaagtctgtttttctactaagtcatttagctcctttattgctttctttatgtggctatttttcaacattctcttaatgattcagagatattcttgtgattgttaaagacttcacaattaaatacgcggcacctgttaggatgtagcgggcactagtgactagcaaagctttggttttgagttacagtgtttgttctttatggaatttctgtattttcccctgtagccttcctgttagatattactgctgttactgtatctttctttaaccacctcttctttcctcgtcttctagcttctggcttttaataaatgtgctatggtaaaaaaaaaaaaaaaaaaagaaagaaaaaagttaatattgcttacagctatgtgtaataatattcagtaattttctcaacaacaaatatcttctatggccaggaatagcataaggccattaagttgctgtgagataggagcagagtgcatctgcaggtgtctgaaggaggagagcagaatgagaatgcactcagagagttcacgcagcccctcgttccctcatttttaggccaggaagtggctcatctggcttatgttttaaatatcattatgattggtctatgccaaatagattttagagaaacaagtggtagaagtaaaatcaggatagaaatgacagaggcttggactagggtagcagtggtggatatgatgagaagcagtataatacaatttctgttttgaaaatgttaatacataaaatcttgtcaactttttaaggggctcaatatgggaaaatgggttatagatacgggtaatggcaagagccactgacaagtttaccagtgacaagatgtgccaaaggtttaggtatgggctgagacacagaaagaaataataaaggacacctcccaggttttggcctgagcaactgcctgaaggtgataccacttactgaggggcccagtaagaaaagcaaacttggctggggaagaactagaaaggaaatcgagagttcagacctgccatgttaaatgtgagatgcagccatacaagtggacgtgatgacaccattctgtagttcaagtgaatgttctggctagagatatccatttgggaattttcacagtagatacagaattaaaacctatgcaattagatattatcaaccagagagcaagtaatgatagagaaaaacaaagtataaggaaaacagtaacttgggcagtgcaatatttagatgtcataaagaggaggaagatccatcaacgcagatagagaacacgctaatgggatagagggaaaaagtaacccaatagtacgtggtgtcctggaagccaaataaaggaggaaaagcagctggactgtgtgatatgctattcagagactgagtaggtcaccactgctttgagttccagaatctgagtctagagggtcgcacataagacttaatatttaacgtatgtaatattagttacatgtattttccacctcctaaatttctcccaagcccacccttctttcagttttcctacctgtacaataaatggcccttattaacccattcactcatactgagtccattataaaaacacaatagtccttaactctgaaatatatttcaaatctactcacttctctccgtctctactgccaacctccttgtgcaaaccatgtttgagaacttttgtaactcattttttgagaactattgtaactgctctttaactaattcctcatcatcccttctttccactcttggcttttataatctaacatgcggagctctcaaggtttgctgccatgttaaaaaaacagtagcagagaaaaccagaaaagaaagcggattctaaggttttggtctgagaactccgtgaatggcaatgccatttattaaaacagggagctctaaggaaggtgagtttgatgagggattgagaaacgtggaaatcatgtgtcttattatgtcatttccatttttttttttttttttttaaggcagagtctcgctctgtcactcaggctggagtgcagtggcgggatctcggctcactgcaagctccacctcccgggttcacgccattctcctgcctcagcttcctcagtagctgggactacaggcgcccgccatcacgcctggctaatttttttgtatttttggtagagatggagtttcaccgtgttagccaggatggtctggatctcctgacctcatgatctgcccgcctcagcctcccaaagtgctgggattacaggtatgagccaccacgcccagcctatcatttccatctctttatcagttctaaaaaattatattcacaatagcataaaaagaataaaatatgagggatattttaacaaaagtagtgcagagcttgcacactgaaaaccataaaacatcgctatgaaaaatcagagaagatctaagtgaacagagagatagtccatgtttatggattcaaagactgagtgttgttaagatggcaaattcttaccaaattgatctatagattcaacacaatccctatcaagaattcagcaggcttttctcatttaaaatttttgcagaaattaacaagctggtgctaacatttatataaaaacacaaaggaatcaaattagccacaataattttgaaaaataaaaatgaatttagactacttacacttcctgaatttgaaatttctataaagatacaataatcaagacagtgtggtactgacataagcatggaaatacagatcaataaagtagagtcaggaatccagaaatagctccttacatataaaatcaactaatttttgacaaagctgtcaaggtacttcagtagggaaaggatagtcttttctacaaatgtgttggaacccctggataaattcatgcaaaaagaggaatttaggctgggcacagtggctcatgcctgtaatcccagcactttgagaggattacttgagcccaggaggaggattacttgagcccaggaggtcaagaccagcctgggcaacatggcgagacctcatctctattaaaaatacagaaatttctgggtgcagtggctcatgcctgtaatctcagcactttgggagtccgaggtgagcggatcacgaggtcaggagttctagaccagcctgaccaacatggtaaaaccctgtctctactaaaaatacaaaaattagctgggcatggtggcaggtgcctataatcccagctactcaggagactgaggcaggagaatcgcttgaacccaggaggcagagattgcagtgagccaagatcgtacctgtgcactccaacctgggtgacacagcgagactccgtcctccccaccaaaaaaaaatattagccaggcatggtggcatgcagttatagtcccaactacttgggaggctgaggtgggaggattgcttgagcctagatggcagaggatgcagtgagccgagattctgccactgcacacactagcctgggagacagagcgagactctgtctcaaaaaaaaaaaaaaagagagagagaaatttacacactttactcatataatacacaaaaactaactctagatagatcatagacttaaacgttagagttaatattataaaacatccagaataaaaacatagaagtattttttgcgaacttgtgttagagaagagttcttagacatgacactgaaagctcaattcatgagtaaacaaaaaaagataaattgttcttcatcaaaattaaaaacttcatcatccaaaatataccattaggaaatgaaaagacaagctacacgctggaaaacatatttgcaaatcatatatttgacaaaggacttgtacccagactatgtaaaaggctcctacagctctattagaagacaactcaattaaaaactgagcataatatttgaatagatattcacttaaaaagatatatcaatggctaacaaacatgaaaatattctccatgccattaattaatcagggaaattcaaattaaaacatgcatgagaaactatttcacaatcagtaaaatggtaatatccaaaaaaataaaagataataataatacaccccctaccacatgaatcagcagttctactcagaggaatctactcaggagaaataacacacatagccacacaaggacttgtatgcaagtgttcataccagtaagaaaaggcaaatcttataggggcacagagtagattaaattaatggttgcctagggctggggaaagagtgtggattaataaaaatggacacaagagatcttttgggagtgaaagaaatgttctaaaactgaattgcattaatagtagcataagtctataagtttatacacattgatttgtacactaaatctcagagaattttatggtgtgaaattataactgaatagtattgttaaaaaatgtaacgttctttctgcacaaataaagtcaattaatccttaataaaggagaaaagcaattcaatagacagaaaaaatagtcttttcaacaaatggtactggaataattggacatgcatatgcaaatataaaaagtaaatatattgaacttacacttttcacaaaaactgactcaaaacagatcttcaacctaaatataaaccaaaatattataaaacttctggaataaacaagaggagaaaaattaatgtgattttgagtttggcaatggatttttagatataacatcaaaagacataatcagtgaaagaataaaaatgtcagttttattaaaatttaaaacttctccacaaaagacactatcaagagaatgaaaagacaagccacagaataggagaatatatttgcaaaacagatatttgatagaggacttatattcaaaatctacaaagaactctaagaaactcttaaaactcaacagtaagaaaacaacacaattcaaaactgggcaaaagaactggaaaaagaccaggctgtcaaagatacagagacagcaaacgagcatgtgaggagatgctcagtgtcgcgcgtcatcagggaaatttgattgaaaacagcatgctgataccattatacactcattagaatggttaaaatcaaagaaactcacattaccaaattcctatgaggatacagaccaacaggaactctcattttttgtgggaatgaaaaatggtatagcagctttagaagacaacttggcaaactcttacaaaactaaacataatcttactatacaatccagtaatctcatccatatttgatttgaaaacttatatctacacaaaaacatgtatgaatgtttaagcagctttatatataattgccaaaattgaaaggaaccaagaagtccttctataggtgaatgcataagctagtagatccatataatggaatattattcagtggttaaaaaaaagtgcaatcaagtcacaaagacaaggaggaaactgaaatgcacgttggtaagtgaaaaaagccagtgtgagaggctacatatgatatgatccaattatatgacttgtaaaatgaaaacctgccatctatgaaaacacaaatcctgattgctaggaagtgaagtcagaggggatcaagcactgggcttggggcgatggtgaaaccatcctgtgtgatgctgtaatggtggatgcacgacattatgcatctctgaaaactcatcaaacttcacagcatcaagagtgagccttaaggtatgcacaatttaaaaaataggaggctgggaatcccagaaagatatgcagaatatgacagaggaatgcgactgtatcataaatatatcaaattacctcactgaatagggtcaggagaaaggggctgacctaaataactttggaattgagcaaagtttctaaaaattaaagaacagcaactgcacgtaagcactgtactgtagctggcaaagttgtctcccatgggaatacagcttcacgattcttagccctccccttacttctctgtaaattctcagtctaactgtaagaacctggcttctctcacccaccatcgtttatgtagctgttcagtgatatgacacctttatacaactattcgaatggctgaaatataagcaactcacgtgaccaatgcttatgaggatacagagcaaagggagctctcattcatttttggtgggaacaaaaaagatacagccactttagagtttggcaaactcatacaaagctaaacatgaataggtatataaatgaaggtgggttggaaaagccaggttattttttggttagaatttacagataagagaaggaggctagaatgatgcctttgttagcatatttgaattggagacatcagtataagctcacatttagcttaatatagatacagatggccacctatggaaatatttatagatgtatgtatatacatgcgttaggatacacacatctatttctttgctctatcagctgagaagatctaaaacaaatggcaccctcgtatcaatgaacacacctagatcttgcattgactacctcctccaataaaacaaaccaagtcttcttgtagagagggctgatactaacaccaaggccaggtgtatacaggatgagcctggagcatccagtagtcacagaaagcagggcgtgcaccctcctccccacagaaaacctcacatcatgagggtgtgtgaagggggcacaaagccaactgaaagcgctcccaatggccaaagctggaacgatttgagccacaaaataagtcgtgttggattataatccaaactataaaagaaatatccatggcctggtgcagtggctcacacctgtaatcccaccactttggaaggccaagatgggtggattacaaggtcaggagatcgacaccatcttggccaacatggtgaaaccccatttctactaaaatacaaaaataagctgggcgtggcggcgcgtgcctgtaatcccagctactcaggaggctgaggcaggagaatcgcttgaacccaagagacagaagttgcagtgagcccagatagcaccactgcactacagcctggcaacagagcaagaccctgtctcaaaaaaaaaaaaaaaaatccacgagtctacactgatataaagaatgattgaataaatgaataaatcggggagtcaaatcaaatcccctgccaaatcatttctaataacttatgccactgttttgcctttaaggaagctactccagccttgagggattggagcataactcctaatccctaagtgtgagctacacatacagactcccttccaaggggtagattctggaaagtgcagggcgaggcagcggaggagccactttacagggaagaaaacacgacctcagccaggtgattcaagtcgaagtcagaaccaacagtcacaaatcatgctgacagtgcttgcccacgatatgatgcaatgaaaatggcggcttagctttgtgattttcctctacaaaagacacaaatctagtctaatcatgaggggaaaaaaagtcagaaaatttccaacagagggcaacctacaaaagaggacttctcaaaattgttggggtcatcaaaaacacaggaagtctgagaaactatgacagccaagaggagcctgaggagtcacggccactaaatgtaacatggtgtcccataggattccggaacctaaagctgatgttgggtagaaactaaggaagtctgggccaggcacagtggctcactcctgtaatcccagcactgtgggaggccaaggctggtggatcacctgaggtcaggagttcgagaccagcctggccaacatggtgaaaccccttctctgctaaaaatacaaaaattagccaggtgtagtggtgcatgcctgtaatcccagttactcaggaggctgaggcaggagaatctcttgaacctgggaggtggaggttgcagtgagccaagatcatgccactgcactccagcctggggaactgagtgcgactaagttaaaaacaaaaaaaacctaaggaagtctgaataagctatgggcttcagttcataagatatttataatattagttcattaattatgcaaaggtaccatgctaatataagctgttaatgatagtgggaactggcttgggtgtatgggaactatctgtaccatcttcctaatttttttatgaacctaaaactgttctaaaaactaaagtcagagtcgatgtttctatcagtatccccactctccagccatgtctttgtgttcctcttcctcgcagtgcatgtgaggatttgctccttggcctggaacactgtttctcttgctgtggatcaacataagcctaatccatttaatcatggcgatctcatcatcagctcccacctaaactgctcctcttcacagaagagttttgctgccttcaatctactccattgcactctcactactccctcgagtttttcttcacaggacaagccatatttgtattatctgagtgttattaattagttaaagtctatcacctccagagactataagctccatgaaagcaaggactacatttgctcccaatttcaatactgagagtaacattgaatattcgatcattttaatgaatgaatacacgacagaaaaaatgaatcctgacctctcaaagattatgtacttatttttacttccttcttggcagcatgtaagattacatatattctaaattattgatagtgaacttctgtctaacccacgtggtattctaaaagacattttaactattcagatacagctgaatatttgtatcagggtaatacaggcataaatatccagtggttaaacctccatgaatgtacaatattttagtccatattttacatagtcattaaatgctttattgaagcagagtaaagtctgaaaactaaagccaaatcctttgacactaaaaataaaaaaaaagcgggtgtccaagcaacataacggtcagtgatttgctacttaacaaatgaaaaacaaagaaacaaaatccaaatcaatgtaaacaatatatacctctctgttgacaatgacaacaggtgctatcaacacagaagatgatataaatgtaagtgctttagtcaacattacagccagatgataataagaacatttcactctgcatttataggacccagtagcagtcggctgttaaagaaaagtaacaataatcaaactgggctaagtattttctatgtgaaggtatcatgaaatttatgaagtctgtgtaagaaagataaaggcattcacttttgaaagaataagatagtttaaacctcaacattctctatgcttaaaattgagctaatttgaataaacagaccatgacatggaactgtcactttacaagttcctgctttagtctttaactctcaaactagcattctttaaactgtctaacactgtgaactagttttaatgcctccagctttgtctcctattattatgagcacattatatggagtgaaaaaagaggaatattgttggacttaatagtaaatataatatggaaaataatgcaatgagcacttaaacaaagttataaccatggttaaacaaaagaaagattgtatgtgtcagctgctgaaagacattctaagttatttgtgtgcaatatactgttgtttgacagaactgacacctaaatgtgaatgatggtttgctttcgctaatattagggcatgaatctaggtttaatccagtccagtcaaacctggactatgcctcactttttcttcatagatttgacaatgggtcttcattttaaaatcacttacaaccacgaagagaaaaaaaaaatctcttcactggtccgtttggcaaatgacagtttgcttgagatttccttctgagatcaaagaggaggaaataatgtcacgctgcaggaatttctaatgattaatgttattaccatgaacaccaaaggaagtgataataatttgccaagtgtgctgcccggttttccagtattaactcatcactatttgcttcctcagagtaaggatttctcacaaataaggaaaagggatgaggagatatgtattgcttttgttttccgagaatgccacgcacccacactcagcacaccctagcgagattttagcctatgcatgtgcgtctttcctgcctttgcctgtttctgcctcttgaccagcgtctatcaactatggagctcgactccctgccattaaggagacagacttcctggggtgctctgctcccacctgctcccttttggactaaacaatgtgtgtgctcttctgttacagagtcagttccttccacaaaattaccgtcttgctgtcattggtatggctgccagcaaaccatgccaaggtcttctggtgtgcctacagctaaatacttgaggagaaagaggggaactttgaagctcttgatgccacactcagcatggaacaattttggcaaagcaaccatttgaaatttgcttactcttcaatttagggacggctctgatgatttatgagttcagtgagttgaattcaaagatagaaaagagcatgtttctcctggacaattatggagaaagggagaattagctgttccttattcttcttgttagttaagtcctatttgaactgttcttgcctcatgtgatgggaatgtctaaaaatgccaaaggagccatccatttatttccagaattagcaaaaaccacaaacttcgctgctgaagagcaggctcccacaggaactcatataattctgcagcgtgccattgactttaaatggccccaaatactttcttaaaactctctgatgtgatctatctttgtggtaaccttccacacaaagtgctggaacagtgagaaatagaaatatacatgcttcataatgacttgctagtttaaaatgagtgctttgcacatggcattgggcatatccaggccctctcttgcttgggcataaagccagtctgaaaagtgaatgtataaatcattcagctagatatgtcagcttttagatgtatacgcttcagcttagaggcctaaaatatatcacactgttttcagagttttgtagcttattatcggagcaatagagaaagattttgattgtagaatcagtgtgtctaagtgcatagtatggggcaaatgtgggtatctaatgagttaattcaaaatcataagcagaggcgctattcttgcttcttagtaataaagtgttcctattggagtcatcaatgataatacaactttagtctaaagcaaggatggaatcaaggaattttatttatagtactgtaacctgttaatttgatgggcaaagactgacaaattcaggaatgaaaagaatgtgcttttctttccctttcctctcctctcctcccctcccctctcctctcctctcctcccctctcctctcctcccctcccctctcctctcctcctctcctctcctctcctcccctctcctctccttccctcccctctcctctcctcccctcccctctcctctcctcctctcctctcctcccctcccctctcccccccttcctcccctcccttctcctctcctcccctcccctctcctcctcccctcccctctgctctcctcccctctcctcccctcctctcctctgccctcccctacccttctctcccttccttctcttcttcctcccttccttcctttatccctctctccttcccaccctcttctcttcctcccttccttccttctgtataaagtaagatagaggtaataaactcagtagattcagtataccgatagcatataacactgacaaatcaggtaccagaggcaagttctgcagtagaatctacaagtgaaacttctagaattgtattattaaaccataaaacatgcatccctcccaccctaaagctattttttcttaccacttagatgtaaatcatctgaaataaagttacagattttgagtaacaatattagtatgtgaatatgtgttgctgcttctctaagaacctcctagtatacccagtacacctgttggtaagcccctgtcaacagacagagctggtcatccccagccacttcacaggagttcctgccgtttacagtatttcttcagaagttacgttcaacaattctgctacttatggttttctttttctgtaaatttactaggcaagtcatctctgcctgacttgcaaattcaatgcttgactctcagattactactgctttcatatagatgtggatcttcctttgcaatggttttttttttttttttgaggctggaattcaaacgtattattgaacctctagaataaattaatatttcttttcagggttactatcgatgagactatatctaacatgtctgcctgagtaatttgttttctataattatggattactaaagggtagaatcaaaatatttctgaggttctcatacagtataatgtctagaattcaaaacttttttgttaagtgaaaagacagactgtcttattcaaaaggtgcacattcgctttaataaatgttgacaaagattctgtctttgaaatttagccaggcttctctgagcccattcttaccctggccttggcctcggtctatacagacatgtttgtagtggcctccaaacactaagttcgtttctcacagttgaaagctgcatccccagggacgaccccgaccccggctcggcttcagtgcctgcctgaggacactgcaggctgcccaaggagtctactgtttgctccagccaacccctggagagagggctcccatctcctagcctctgtgggagggtaagggcctcatcttgacaagctccagttaacaaaacaatgtgggtttcacacggaccaatccccgatttcctgctttttgtaattttccacttctctgaccagactgatcccccgtcacccatgctctcttctctcgctcttgctttaaaatgcccagtctcctctgcacaaataaaacttgagttcaattcatgctggactttttcctactacgatggtacgttatggattaaaaaacctgtccttccagctttacctaatggcaggctttgtttctctttggaccatgtgcatggtgtatctttcttctctgctctcagtgtgccagaagtaaaattaagggattgaaccaatggctagaacatctccaaaattcttactcactctgggtatggtctgctatttttgcatttaaaaaaaataacttttactttagacacagggactacatgtgcagatttgttacatgagtatattacacccaggtggtgagcatagtacccaataggcggtttttcagcccttgcctgctctctccctaccacctctagtagtctgcagtgtctccatttttcccatgtttatgtccatatgtggttaatgtttagttcccactggtaagtgagaacatgatgtatttggttttctgtttctgcattaattcaattaggattacggattccagctacatccatgttgctgtgaaggacataattttaccctttttatggctgcatagtgttccatagtgtatatgtaccacatttgctttaaccagtccaccactgatggtcaccttaggttgatttcatgtctttgctatcgtgaacagtgctgcaatgaacatacgcgtgcatatatctttttggtacaataatctattttcctttggatatacacacagtaatgggtttgctgggtcaaatgctaattctgttttaagttttttgagaaatcttcaaacggctttccacaatggctgagctaatttacattcccaccagcagtgtataagcgtccccttttctccgtagcctgaccagcatctgttgtttttttaccttttaataatagccattcctctgatatgatatggtatctcactgaggttttgatttgcatttctctgatgataatgatgttgagcattttttcatgtttgttgcccacgtgtatatcttctttcaagaaatgtctgctcatgtcctttgcccatttttaatggggtcgttcacccttcgcttgttgatttgtttgagtttcttataattctggatattagacctttgttggatgcagagtttgcaaatattttgtaattcccaggctaatcatattatacaaacccaggtctgttagcctgagctgcagtttgagataaataccagtaggtggcagtgcaggtcacatggtggcttattctgcacaaagctgctttcccatgggggtatgcccttgggaagagaggactcaggcaccagtctggacaagcacccttttgttaacgcaaaggaaataagtcaatcaaatcaacaccagtaaagaaaagtatacttagaaataccaaacaacaatattaaaagaaaaacatccttaagagtactgttttcttttctcctcatactatttttgagtttacattgctgctgcattttatgaactctttttgcattgcagccccaggttcaaggcttggtggagtcctgtagtagccacccaagatttcactggtcttcagaaacttggaaataatctctcacaattcgtcttaaaaccactgaatgtatggttcttatggaggagaggctggctaaaggcaaagtaaatgtagatttcgtgtctcatcacagaggttcagcaatcactcgccctgtcctcagtagttccccaatagtcccctcccaggtccccactcactgcctctgggatgcatcccccactccctccccactcccctggggtctgaacaataaatggaaagcaactcggcctcttccctttcaaggtgggcaccgccactctagtttagtgaaaaatctttccctaaaatggtcagattgataaaaggtaggcaacggttcaggaatatttgtgcttccattagtgagatttatgaacttactccaacattctgaaacaatgggggttgatgatacagttccctaaggttctttttataaatttagctccaagatctttatttatctgtaacttctgtgcttctcctgagcctgtggtaacacacacctcttaagcaagggctgctcaattaagaacaccctaggaggcttgcacctgaaggtttggctttatgccagataccatatctgcactaaagagcttgtcttactaaaggggctcactcccattcttttccattttaacaaaggttaacttaacttaaacataaaatatttgaaataattctatagtgactgtcccatagagagagaggaaatgtatttacattgggagctctatggaaatttcataaagtgaatagttctaaaatgaaaagacagaaatctctagcataggttatatgttccagtgttatgaattaagtctcaaagaaattaagttcttcaaaaaagttcctgttataatgacacatgctgaactctttgtgtgtgtgtgtgtgtgtgtgtgtgtgtgtgtgtttgtggggcctctaataccctcatgttttcagtttatattttacagtatccccatttttcagttgaagaatcataaggagatgctttaaatagtttgcccaagaacatcaagtgagtaatttgaccaagccagaaaaattgcaacaaaagctgggtttctgcattgcatcagccagaaccgtgctttctcagaactctaattcagtattataatatttctgctctaacaccttgcagtggggaaaaaattaaaatctgatattatacacacactttggaatcctttaaagtaaatgaaatatttatgattcaacctgggttcaaatgaaggaagtgtaggcatatcagctacagtaaaccaattgatgactcaagatggccaatgatgataaagttgagagtcagctggattttcactggggctggcagcaagacaggcctgatgttgaaaaaagcagacacaacaggtggaagaacggcagagtggctcttgcttttggtctgaacactcccactggctgcagcactgagttctatagaagcatctgctcacctttcctcttggctggaaagacttacatcaaatgattacaggtttaatgagggagaagtgtcaagattagaaagactaagctgtaggtttcatctggtaaacaatacgggaaagaggctgggcacactggctcacgcttataatcccagcactttgggaggccagggtaggagggtcacctgaggccaggagttcaagaccagcctgggcaacacagaaagaccctcatcttgacaaaaaaaaaaaaaaaaaaaaaaaaaacagctggacatggtggcatacacctctattcccagctacttgagaggctgaggcaggacgatcacttgatcccaggagtttgaggctacagtgagccatgagtgcactattgcactccagcctgggtggcagactgagacactgtacagaaaaaaaaaaaagaaaaaaagaaaaaagaaaagaaaaaggaagatatttactcttgcaaagaatatgggaataaaggctatttttaaagatatgtgtgcatttttattttatcttaaacaaagctctctttttacagacctattcaaaaacactgtattatctacatttaaggtttctgaattgttcttgaaaaaggtaagcttagactggtaattgtggctcatgactgtaatcctagcactttgggaggcccaggtgagaggactgcttgaggccaggaattcaagaccagcctggacaacatagtgagatcccacctctacaaaaaaatttaaaaaattagccgggcatggtggcacacgcctgtagtcccagctacagaagaggttgaggcgagaggataacttgagtccaagagttcgtagctgcagtgagctatgatcatgccattgccctccagcctgagtgacagagcaagactctatctctaatgcaaatgaaagccacaatgagataccatctcacaccagttagaatggcgatcattaaaaagtcaggaaacaaccgatgctggagaggatgtggaaaaataggaatgcttttacactgttggtgggagtgtaaatcagttcaaccattgtggaagacagtgtggtgattcctcaaggatctaaaaccagaaataccatttgacacagccatcccattactgggtatatacccaaaggattataaatcattctactggtcgggggcggtggttcacgcctgtaattccagcactttgggagggcgaggtgggcggatcacgaggtcagaagatcaagaccagcctggttaacatggtgaaaccccgtctctactaaaaatacaaaaagtgagccaggtgtggtggctggcacctgtagtcccagctactctggaggctgaggcaggagaatagcatgaacacaggaggcagagctcgcagtgagctgagatcgcgccactgcactccatccagcctgggtgacagagcaagactctgtctcaaaaataaataaataaataaataaataaataaataaataaataattctactataaagacacatgaacacatacgtttactgcagcactattcacaatagcaaagacttggaaccaacccaaatgcccatcaatgatagactggataaagaaaatgtggcacgtatacaccatggaatactatgcagctataaaaaaggatgagttcatgtcctttgcagggacatggatgaagctggaaaccatcattctcagcaaactaacacaggaacagaaaatcaaacaccgcttgttcacactcataagtgggagctgaacaatgagaacacgtggacacagggaggggaacatcatacattggggcctattgggggttggggggttaggggagggagagcattaggagaaatacctaatgtagatgacgggttgatgggtgtatcaaaccaccatggcacgtgtatatatctatgtaacaaacctgcaccttccacatgtatcccagaacttaaagtataataataattttaaaaagactctatctgtaaagaaaaaaaagaaagaaaaagaaaaaggtaaccttgtctgaaaatcttatttatttgtatgagattttcatactatactcaaatattcatccaaacatttgatttaaaaaaaccctctttctcagttttcagttacgtttaaacaagttaggcaaagttactaaatcatgatacaatgaagatcgtattacattttaaaattgctaaaatataaaaaagaacactatatatcttatttttgttacaaactcataatagatcaaactctataatatttagatttgtgacttctttgcatttaagtttgcaaaattccataaaaatacatcccacaattttgtttctagtcttatttcactgaaacaaatttaaacgatttttatgtagattagcaaaataaatgcgatttttatttcagctggaagttgggattattttttgtgagctggaagaagtgataatttactaatcactatactaaggggtcacttttgcaaagaaaatatttcttttacaccccattttaaaaatattattgttttgttgtatatgtaagttttctttggttattatatgtctactcatcttaacagtttttgctttacttatgaataagaatgataaagatcactgtatgcgtaacagctgaactgttgctcattttcctattgaatataacacgaaggaagagtttctaaagcattggaggaagcaggaaggagttgttctaacaaagtgatcatattcacaacgaggaactgttaaaactactgccaaagttcctaactgacatgaaaatctgatggagtcctgggggtagtaattttccctgtgagctctcttcaagaagtccctaaggaaagaatattgcaaaatcagaagttgaagagaaacatacagaaatattcaggttgtgtcttccatgcagaacatatcaaatagctaagagtctgcttaataaaagagaatcagaacaggtagattggaagaaaatctaacaaaagtcgatttgactttttgtttgtttgtttgtttgttttgagacggagtcttgctctgttgcccaggctggagtgcactggcacaatctcagctcactgcaatctccgcctcccgggttcacgccattctcctgcctcagcctcacgagtagctgggactacaggcacctgccaccacacccggctaatattttatatttttagtagagtcggggtttcaccgtgttagccaggatggtctcaatctcctgacctccgcctgcctcggcctcccaaagtgaagccccttggcactgcgcccgaccatttgactttttaaagtgttttaatttaacaacaatgtgtagctggctatatattggtaagggaaattagtgaagtcaaatttgtagttgaggagatcttttcttctgcatttccgcacattgctgtgtaaacatgagtgcaggtgaccgctggtaattctctattggaaacttggtgtcttcattctccatcctccacgtggctccgaagccctgctctgcctcaggtccctgtgtgtccaggccctctatggtcatattctctcacctacacttgggccaatgacatgaacagaattttgacagtttcacaaagcactttcaccttgtgggtgggttcagtttatttccttacaggaggatattaatattgcaggttctaaggcgagaggagctttgtgataagttaagaaataaggaatgaagagaggcaggggaaaagacttctgtgtgaaaatagaagaggcccattttaagcacataattttccttatttcaaagggaatacgcaggcaggttactgtagcagagtcacaaacaagccaatgtgacttaaaagtatgagtcatggggaaatggagtgacacgagatcagctccagggatcacgccttcactttgcctgccttggggactcagagatctgcttgcgggtttcctgactcctacgtgaggtgtcagtgaaagcagcagtgatgttaactttgaggaaatttggttattgtgacaggatagataaatgaaccgtatcggggtttcttcattttcgtaactgtggtgctaatgaggtattcagtatctgtggttgactgatttattccccaccagaaaagatgcttgggctgcagatttcacatttagaaaaaaacatgatcctttggaaaagttgccaccaattactcagtctccagtttcagtccatccacggaatgatctgtctatacctctgtaatgtactgcggccccagtcagccacttggcagctttgcaatcccatgacctttttaaatcctgaaaataaataaaattgtaacattcttgccttgttagctcttaaattttcaaatttctatgtgccaagttgttctgcttaataaatcaccaaggaggtattgtcatgatggattcgtattttatttttattttcagtattgtatgcagtttacttaaaaaagatttgtgaaaaaaagagatagcacttttagctattgctaaatgagatcaggaaattgtcttccaaataggcaagcacaaagctgaaaaaaaatgaacaaaatcatccatttccatactgtagaaattgagcaaaggcttaacacaaatttgagaggcacggatgcttaaaaactgtcgaacttctgggaaaaacgtgggaactatgtcactctggcctgggctgcccaccttgtccagggtgggacgaactgtagagggttttctgctgctggaagggcctctgtggctttggggagacggcagcgccagggcccgcggggcggcaggagggactgggaggcccacagcggtcccgtgggaaagctctgtagggacgggcaggagtgaacatgttgtgttttgtgggctacaaacaggctctatttcctctctgcctcctcctcctgctttttcttccacttttttttaacatttgtttttaaatggaaagtagtttttagctcacaggtcatacaaaagctggcaaacggctggcttcgaaccgtcctggcttcgaaccgtggctgccatgtgcctcccgctgctctactcgcctgaggttgaccctggtaagcggttgccgcctgcagacacggcgcatgcgagggagggtgcaggccgagactccgccccgaagggcgcggcgtgcccgagagatgcgagcgttgaggaaacggaaatccagcgcacacgtgaaaacgccccggactgcggctgcgccgcttacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatggtaagttctatcaaatagtcacagaagaaatcatggcagttcatcacttactgttgatgtttcagaagatagtggactaaggaacaatcccaaatcattttacaaggctagtagtaccctgatagcaaagccaaagatatcacaagaggaaaaacatcacagaccagtatctctcattaacatggttgcaaaattccttaacaaagtattaaaaaagtgaatccagcaaaatataaaaatgattatatactatgacccgatggggtttatccaagaatgctgggttcatttgacatccaaaaaccaatttaatgtaatataccaatcacattcaatttataaaggactaaaatactccgtgattatctcaacagatgtaggaaaataattggacggcatgtaagacctatttatgatttaaaaaaaaaatcttaaaaaactggaaatagaacaaacgctttttaaactgacaaaaagaatttaggaaaacactacaggtaacatcatatctaatggcaaaagactgaaaatccccccttaagaacagtagaaagatgtctacttttattatttgtattcacaattatactggattttctagccattccaagaaaacaaccaaccaatcaatcaatcaactaattaaatgtatccaaagtggaaataaaggagtaaaactgtctttatttaaaaagaaaatgattctatatggagagaatcccaaaaaatccattaaaaaaatctagaactcatcaatgagtttaggaaggccttgggatacaagatcaatatataaaaatcaattgcatttttatatactagaaatacaaaaacacaaaaattaaatgaagaaaatttcattcacacatatgaaaatgtaaactttttggaaattaacaaaagaagatgacatctattgaaaactacaaaatgttgctgagagaaattaaatatgtacataaatagacatttcatattgatggattagaagactcaagatggaaattctctccaaattagtttagaaattcaacacaattcaaaagcccagcaggcttttttttgcaaaaattcataagctgatgctaaaacttatctgcatattccgacaacctgttaaaaacaaaatactgttaaaaacaaagaactacttgatttcaaaaattttgttaaagccacagtaatcaagacaacgtggtgctggcacaagcttagacgcatgcacatcaatggaaaataattgagtccagaaacaaattcctgcctttatggaaaatttacttttcacaaatgttctaaaacaactcaatggggaaactatagggctttcaataaaagcctgcccacacacacacacacacaacaacgtctacccctaacccaccaaacctgtgactatgttaccttaaacatggcaaaggagagtttgcagtgtgattaacggtatagatctagagatgggggggatcatcctggattatctgggggcagaggggccagtctagtgacttgagtcctcaagagaggaagggaaaggcagaagggtgggttaaaaagactcactatgagaagtacttcatccttcatttctagctttgaagatgcaagtggggaccatgagccaagcagtgtgacaggctctaagaagctgggaatgtctgtcagctgacagtcaataagaatttgaggaccttcttcttgcacccacagtaaattcatttctgccaacaaactgaatgagattgtcccctagagcctccagaaaggaacacagcttactgtcatgtttattttagtttggtgaaacccaacccagactttccatctatggacctataattaaaatagtttgggggcattcttagtccacaaatttagtccaaatttaataacaaatttgtgttactttaagcccctgagtttatgattaattcattaagatagcaatagaaatctaatacacaatgggatgaaaaagaaattaaagaattataaaaggatttatgtgaaccatgttaaggaagattatttaaaactaggaaaaaaggcaaaaaaagatgagtagtatgtcctttcaatgtcatattggaacactttatcaatttcaaacaaggattatttaatttcctataataatgcatttttacgttttgctaattggatttgattgacagctcaagttttaggaagtaacatgttaacttgacaggtttcatttcagtagaaaagatatttccaaaagttatggtttcattgccctgtagggtattagccagttttgtactaacctagcaaccctatgacaaaggtctatttttaaaatacctgtaaagactgtgtacttcacagactcttggaaatgctttatattctacctagtttgctcactcttgagctaacaagtctttggtgtatattaattttatgaatcatacttttaacttttttaaagcattatagctggacaaccataatgtattacttttaagaattctggataattttgagacatgccaaattagacccatcagtaaaaaacaagatttaataaatagaaaaataatgaatgaccatatgaataaatagatacagaataaacaaatggtacataaaggttgacaagaaaaagccttgatgattctggaatgttacataataatataggaatcaacttaggctgtcattttcaatatcttcattgctatcaatttatgagggattttgttagcattaatgtgatatacaatggaaatttgaggaaaaaaatgacattgttttaggtgaaaatggaaaatttaacaggaatataaggaaaaaaaatactcctgggaaacagtatttcccatacttaaagcaagaagacattctggtgaccaataggctcacatgctagttttgagagaatttgtgtggaaattgatcagtaaattttttctaaatgtcctagagactttaggtgatactttggatgatgacaggatttttaaattataatatttctgtagctacttctctttttaaagaaaaagatagcaatttttttctatctcctgggtagaattttgtagtttaacacatctctatagccaagagttcatttttttccctcagatcagatccttatgcctgtatctctagctctgatagaacttatgtttcattttaattatatattattacattgtccctcaaatgatggacaatgcattttcctgttaaattttaaaattgccttaattatgtagttgagggccaaggtactttacatacatcacaattataccagagagaaccatgatgcaatagagtgcaattgtgagagctagagtattgcctcattctgctactaaatttaaaatagtctgggggcactcagtccaaaaatttggctcccgtttcccactgttcctaactcagtttcttgtctcattttgtattctctgaccaaagttattcaggctaaatcagtattaggaaacaaagattagcaagtgaattgtacttttaattattcaatatgcttgtctgtaaaataaagctgaacaatggccgacttcaattcgtggttttaaaataagtggctaaggaaaagccaaactgctatgtggatttttttttcctctacccaagtttgtatcaatcccaggcactatcgtagctaccaatctggcacacgtgacacactttggggctgagatcagcattttacataaattttcaacccagccatccaacttgaaagacagaaacttccatctccagagtggttttatcacccatgaggaaagctggccccagagaagttaggccccttgggtctatggtcacacaagctgacattcagacccagttctgcctgaacccgccggctctgtccttcccattaaaatgagggaattgggaaacctgagttctggagctgctttgtgacttagagtcaatcatgttacctctctagatctttgtttctccaacaataagagaatatgacaaggctaagtcaggttgaacatctcttccaaacttaaacgcagatatgacacatagtgcagtgtttactatataaccatgttgtgcttatcctttgaggaaaaataatagaaattctagggccaaacttttcaactttttggcctgggtgacttgttttcctccttaaaaaatccatatcacagagccacctgcttccacagttaccatattaaaatcatcctaggattttaccactgatcttcatacatgtgtatttggactgagtcacattttgttgtaaaaataaatgatgtcagataaaacattgtgtttaaaataagtggtattaataatctctttaaaatgcatgcccatgaaacattaagttgtctgaaagaaatataatctgctttcaatatattttctcatttaagttgagcgttcatgtgttcaattcaccctaaatacaaaataattcttactttcctaagaatttttcatgaaagcatgttaggtaactggtaatgccaaaatgaaactaaggcactaagtaatagattatgataaaaagaaagaattcatgctgagggaaaaaaagaaaaagatgagattggacttaaaataagttacatggacccatttggagctgagtctaacaaaatatgatttatgtgcaaagcattttttgttacataatttatgaagcaaaaacgtggaacatagcatatggtgagttgatttggaagaggggatttaagcataatcattcagcctggggtttatgccgtgtttgaatatctgtcatacctctgcctggctcccatccccacatgtgacctcctgcatggtgagacttacatcacatcccacacactttctggactgttttgattattcactgttaaccttaaaaagtatggcttcctgttaggcacttttatttcatacaacataagttgtatgcagtgtgcttcaaataagtaaacaaccggcaggtcagaatagcttttatttatttgttttgtaaatcccagctttctctgggtcctcataaagaggagtaatagagaaatagtttctggccactctgctttattatttcagacatgcatggcctcctatataatttgcttattgatttcaataataaagaccaggaaattacatcctctcttgtctgtggagctatgaatcacagattgcttaaccactgtcaaattaaacaacttgcctgtgactgagaaaggattcatataaagactaaaatgatcatcagcctcccactaatccagtgtgtcccccatgttaaatgaagtcagcatcactctgggcagctgtgctgcctcctttgaggaaatcagcctccttctcaatcatttgtactgccacacagtttgaatcccggattctggaagattatgccagatacctttctctcctgggagataactgctcaaaaacaaagacacaattaaaataaaaattagacatgagcacagtggctcatgcctataatcccagtgctttgggagacggagtcaggagaatcgcttgaggccaagagtgtgagacaagcctgggcaacatagaggatcccaatctgtacaaaataaaaaaattaaaagaattagctaggcgtggaggctcatgtttgtagtcccagctacctgggaggctgaagcaggaggatcacttgagtccaaaagcttgaggcagtgagctatattcatgccactgcactctagtttgggccacagagtgagattctgtttctacaataagaataaaaataaaaataaaataataataataaaaataaaatcaaacaaaacattgaaagaactctggtttctgattatctaaaagctcccaactgataccggaaatactgttttctaatgctaacatttgaatacccaaggtctctcatagatttattgcatcaaatctctgggttaaatttagaatgaggttgatcttcaggagcagattctcattctaaatcacacaattgtatctagaggctgagtgtttaaagggacaagaccaacagtgggctctgggtgcccagccgagcaacctctagaagtgttttgctttttcagaaagcaatgaaggggcttaaaatcatttgtgaaaatgatttaaatgatttaagggttgaaagcaaaaaacaaacaaacaaacaaaaaaacctcatctgggcccagtattctcattataggtagaataatgatagaaattgcaatgcacaattttactgcaaattttgcttgaaagcagacaaatcatcttggaaaagtagatttgactccctgcactttagtttccttatctaagcctgagggtttgatgatgtcttcgatgtttttaggagttctaactgtatatattttaatgccaaaataatctttgtggccaatcttaattctacaatttgaaaatagttttaagttaaagattttaatgcgcttggataacctgcaaatttacatttaaacctgtttatgtaattattcactcacatttaaatgtggtaacttctgcccatgtgatcttaaattaaaacattctttgaagctagatgaatacttagcatgttaataacatctgatgagacccagatgaaagctggtatgaagtacttcttggtcaagaagttctctctctttgttaatgtaaattttataagtttccattacccaatgaacaaggtatataaattggatgagttcttcttttttgaattatcgtcaggttatacaaagaggaaaggtggaacattaaaaagaatgaaaattcaaaggacttgaatcattggtctgttagtaaatttgcaattttataaaccgcaatgatttataaactattcaaaacattaatatttacaagcaaaattatgcaaagcatacacaacttttgctgtcttgattagactgcatcttttgtctccaggtaaaaataacttttaaagttattttcaaaaaatatttattttttgatgcttaatttttagttgcctagtgaaatgattgctattcatatctaaaaggaaaacgaacctcaggtggtatgtcacagtgagatgtcattaagttattattaaaaatggcttatatgcaatttaaagccagcttccacgaatgactcttgtggtgaacaagaaaccaatatagattatttgtagaaataaatattccttgattcctagactcctataaaaccacctgaataatattgtgcactgactgtggaaggattttgataaaatgtacgtttttcatgtcagaatgaatgaattatgtgcatgatataaagcaatagctcccaaatttcccacaaaggacatcttttgttatcactgttttttttttttcatcagtatcagtggtttaaaagatatttttctattaccacgagatagccagcagtaccatattggctttctacaaggcatttttaggttgtgaggtgcttctgaggctaaagatatattacatttggctttttgaaatagtgaaatataaatctctaatagtctgagaagttgaaattgggaattactagtgtaaagaaaataacttataaacaaggcccttgattcaagtcttttccatgactttggttaactttatctattaaaaaaaaaactaggcaatttttaagtttcccttttaatgctaacatttcatattgtgttttcagcatcccacttgatgaaaattcctgttataataaattagccccttgaggttcctggaaaagcatgaagacttgatatcacctccttcctcccactctccatgtatacaaacactccaattgatactttctcttatattattatttaaactattttctttctgactctgcgttctatcttctgtcttgactttattcacccaagatgaccaaaaagacaaagatttgagctatgaggtaggtgtatgatacataggggaaaaacacatacatatataggttatatgaatatatgtatatctccatatatatatgttatatacccataaaatatgtaccaaattgctccttcaagctatatattagaccataaacacaattaaagtataaaacaaaatgaaaatataataaaggtttttaatatcaatgactggtataaaggcattcataaatagcattttaaagaaaaatacatttaaaataattaaaatataaaataaaaaagtattttgaaacattatctttaatgtttatagcctaaaatatattttttaaataaataaagtacctacattaaaaggtctaagttttttttaacaaaataaacacaggtctaaagaaaaaaggaaaacataaatgtataaaagagaatgtagcaaaataggaaataacaaagaggatcagtaaatataaaagttatttaccttccccccccaaaaaaatgaataaaatatacaagtctttaagccaacttttacagggaggtgctgtggtttgagtatatgtgtcctcccaaaattcatctgttaaaacttaatccccaatgtgataatatcaagagctgtggcctttgggaggtaattacgtcatgagggctccatgtttatgaatggaataacacttttaataagtatccttacttattaaagaaacttaagaggaactctttgcccttctaccatgtaaagatacagcaagaaggtgccatctatgaaggagaagacaagccctcaccagacaccaaatctgctgatgctttgatcttggacttcccagcctccagaactgtgagcaagaaatttctatttctatttcacccagtccaaggtattttgtaatagtagcctgagcaaactaagacaggaagaaaaaaagtatatatagctgtatcagaaattaaaaggggacataactacggtagaatatatacttatatatatatttatatatattttgacaatatatcaaaaatttaagttaatgcatttgaagaagataaaattaatacctttctgaaaatataattttaaagtattccttaaattacaaaatttaaatacaattatagaaattgaatcagtaatttaaattgccacaccccaagttaccacagatgtaattttgcagatgcattttagaaaactttaagataaaaacttttcattttcccttttttatttcaaagaatagaaaaatgttcctcttccattcgtggctaagcaaattcttattgaaccaacccttccacagatagcaactctaaacaaaatgttgaaaaagcaactacctgcaggcactggagagtgaaaataatgtgggagacactggagggaagttatgaataagataacagtagggtgtgactctccacttgttaactgcttttagaatgagagcagtctgcaggtgttgccacacaaagcaactaaaattcatatggaaacccatggacttactgacttgaaaggccaggggcaaagactcgggcaactgcagctgttggtaagtgaaggagcatattacaaagaagaaaggacaatcacagggaaacaattttgcataaaaagcagtctgaatctctagacttcaaaaggccaactaaggttttacccacacaggggagatagaatcagaagttcaagttcagctactgcttaacattttttcaataagaatgaaaatccttcagagtaacataatttagaatttagagtctctacaatgtatcacagtgttcaacaatcttatattacttggtatacaacagaacagaaaataataaacgttctcaagaagaaagaatgtcagagactaaccctgagaccatccagataaagattttgaagtagccattataactgtgcgcaaggatagcaaggaatagattgttaaaacaaatataagatagaaaatctcagcagagaagttaaaactattacaaatgaaaattagaaaactaaaatatatctgaaataaaaattttgctggatgagtttatcagcaaaatagagaagacagaagaattagtgaacttgatgactcctcaatataaaatatccaacctgaataagaaggaagacgattcagaaaaataaataatagaacctcagagaactgtgggacaatatcaaaatgtcaagtgtgtgtgtgtgtgtctctcagaggagaaaaaagagacaataaagcagaaaaaaattttgaagaaataatgtctgaaattacacaattgtgatggaagacataatttacagattcaagaaactcagtgaaccctaacaggataaagttatacatatgtacatactcatgcacacacacagaggccttaatacatcatagacagactactaaaaaccaaagataaagagaacatctagaaaaaagacagaggaaaatgataaattccatataagtgaataatgatttgaataacctcaggcttctcatcagaaatagtgagagccagaaaaaaaaaaaaaacaacttttttaaaatactagaagaaaaaaaatgtcaaccaagaattctatattcaatgaaaatatcctttaagaatgtagataaaatgaagacattttcagaaaaatgaaataaactaatctctactataagaaatgctagagggagttcttcaggctaagataaaactataaagaaacatgaatctactggaagaaataagatgtattgcatttacatgtgttacaatccctgtaatattttaaaattagtattatagggattatagcacatgcaaatacagtacatatgacaactagagaatcaaaactgagggtgtggtgaagtgatcatgcacttgcaggatttgtacactgtatacaaagtggtttagtattaactgtgtaaactatgaggaggtaaagattcattgtaattataggaacaaccactaaaaaagaaaatagctacaaaaataaaaaaattaagtaaaagaaaataaaattcctaaaaaatttatatattccaaaagaatgccaaaaaggagaaagagaagtacaaaaacaaagagacaaatgcaactcataataggaaaatgatagatataaatccaactatatcaagaattacattagatcatcaatcactccaattataaggcagaaatttttgtaagaaataaaaaagcaagattcaactatatgctatctacaagagaaacatattaaaaataaagaaatagaaaggttttggttgacagtaagtatacctaccatgcaaatagtacacataagaaggttggagtgtttatggtaaaatcatatagatttcaagataaggaatattaacagataaaaatgatgaaagttttgtcaggaagacaaaacaatcattaaagtatatttatcaaaggatagaagagaatgaaaaactactcatatccttaaaaagattataaactatactgaaactagtcaattttaagataagaaataagatgacaatctcacatagtatatatacaaaaattttcaataagctatcagcaaattaaaattgtcattataataaaaaattatagcaagaagtgttcatctcagaaatataaagataatacatcacaaaacataatacaacacatttacatattctttttttttttttttttggggacagagtctccctctgtcgcccaggttggagtgtagtggcgtgatctcggctcactgcaagtttcgcctcccaggttcacgccattctcctgcctcagcctcctgagtagctgggactacaggcacctgccaccacgccccactaattttttgtatttttagtagagacgaggtttcaccatgttagccagcaaggtctcaatctaaacaaaatagtatgtttataatggcaaaattaattttaaaaatttaatactgactcatcaagaaaaataacaacaaaagaggccattttcaaagcaggaagagaaaggattttttttccccgagtaagagtttctagtaaaaactttaacatacatcagacttaatggtgacaggttagaaaaagtattcccattaaacatatgaataagaaccaagatgtctgcaatgttccattatgttagacattacattggaggtatgtgtaaagataaagattttatgaggagatattccaaagacagatttgtgattctttggatgtggcactgttgaaggtgaatctaaaagcttttatggagcaatgtcaaatttgtgagccacacggagatggagatgagattataatacacttttatatgtactatcatagatgtaaaactctctatcttaatattaactttgaaaatgttaaattgagaatcctgttaacttacattttatgaattggcatattgtattactgcaagatatatttgattttcagcataatgccaaaacaaaagattttttaaaaaactataaaaatgcatatatttttctaaatttattttgtcttaaagcacactttaaatgtcatttctcattgagcaaaattgtcaaatttctatggaaaattttaagataaaaagaaataggcaaagaattggaaagagacaaaattgacaatatttatatccaatttaatattctaagtatataatccaagaaaccatacagataagttactaaaacttgtaagaagatttgatatagttgccagattactatataattgaataattatatagaaaataagtagcattctaagtgcctttaataatttaagaaggacttctgcttatagccacaacaaaatagccagaactggattaactgtcccagctaaaatcactaaaaaataatcaaaatatatgtttttaaacacagtttcagactttggacaacatgtagcccaggacagtgatccctgagaaaaggaagacaaatgaggtgacactgtgatagacccagatcaacgcctggaaaaagtttcaaagctacaatgtgaggagtggggacaaaacagtctagtggctttgctgagtggagaaggcaagtactggagtccaggcaaagtattggtgaaggtggagccctggagaaaaagaactctagagatctgtaagaggctctccttgaaacttctactgagcacagttctgcacatgcatgtatagaatttactcaagatgaagaaagaaccaacgaaaaaaagcatagtataatgctgagaactcataaaatcgagtaggaaatcttgcctattgaaagagcattgagacagagtcctcagaaggaattttctcagtggtgggaacaaattagctataaacccaagtttgctctgatattgctataacaaagcttaaaagcaactctcaaaaggctcaaactgagtacaaaacatctaattgtaacccagggtacttcccaacagtattcaagggaataaaatattttgtgtatattttgtattacaggaatatattgtattcctttatatagcatattgtatttctttatatatgaaatgatatatcatcctaatttagagcatgaagttacagatgtatattataaactctagaacaaccactaacactattttagaaagctataaatgataagcaaatagagataaaatagaatgataaaatataatcaatccagaatatgggaagaaaaagaaaaagggagcaaaaaaaaatgaaaaaaatgaaacaaattgcaagatgacagatttaaacctaatcatattataaccacattatatataaataggctatatactccaattacaaaacaaagattgttgaataaaaaagtaagacccaactacatactttcagcaagaaacccacttcagatataaagacataaattcagtaaaactcataagtcaatgtcataaatacatatatataatatgctcgcactaattaaaagaaagctggaatgactgcattaatatcagaaaatgtagatttcagagcaaagaatagtaccagggataaagaggctgaattcacatattataggggtaaaatatttgagagaacataagattagtctatgtgtatatctgatagcccagcttcaatatatatgaaagaaaaattagtggaactgagtggctagatatacatatctacaattgtatttgcaaagttcaacaacttattcttaatcattaatagatcaagtagagaaagtaaggatttacaagaattgaaaacatcaccaaccatcttgacatttatcgagcaactccacccaacaagagcaggaggtatattcttttcaatttcccatggaacattgaataagatagatcataaaacaggtctcagtaaatgcaaaaacattaaaaccacacaaaagaacggtccatgtccacaaatgaattaaattagaaatcaatagcagaatattttaaatattcatccatattttcaaaccaaacaatatacttctaaataactcatgggtcataaaagaaatgacgaggcaagtcagaaagtattttgaactgagtggtaatgaagcactacacatcaaaatctgagggacagagataggtaatgtttagagaaaaaatcataaaattaaatgctcatattagaataaaaagtttgtcaaatcaatcattttgaagcctgcatcttaagaaatgttcagtcttcaagatggtggaatagaacctttcagcagttgtcatcaatgtgaacaactatccacacttgaagacacctttgcaagcattaaggaatccaggtgagagactatgacacctgagtgtagtatggaactaagaaatgcactgaagagagtggaaggacagtttcacatgacccatgtcacccttttccatgcccaggcagcacagcacagagatgccctctgggtgggaaagtagagtgatgtcaccacctgactttgtgtggagcccagcaccaggtacaccccagagaaacccagtgctgggctgattccagcagccccaggatccagattagcctctgtagatataggctgcaggcttgcccggcatcaagctggcccctgttgccccagactctcggctggttgcaatggccacatgttcccagctgacccagtccccaggcccatgtcagtgccagagacctagccactgcggacctagccttcaggccagcatccacagatgcagtctcttggccaggctccatgtacccaggctctatgctagccccatagtctcatgtactaggccagcactcatggacacaggcttgagactggcccctgcagacccaggttcccaggcctgtcccaggaccaagacagcccaagctccatgtcagtccccacatccacaggcttcagtggacccaaggtccagtcttgctccagtagattcagagtgcaggctcacctcaaagtcagcagaaggaaggaaataataaatatcagagcagaaataaatgaaatagatagtttaaaaatcagtgtaaatatcaatgaaactaagagatggttttttgaaaagataactaaaattggcaagtccttagctaaagaaagagaaaagactcaaacaactaaaataagaaatgaaagaggaagtattacaactgacaccacagaaatacaaaggattataagagaatacattagccattagccatataacagcctgagccattatacattgccaacaaattggataacacaaaagaaatggataaattcctagaatcatacaacccaccaaggatgattcatgaagaaatagaaaatctaaatagagcaataatgagtaaagagattgaatcagtgatcaaaatatctctcaacaacaacaacaaaaagctcaggtcctgattacttcactggtaaattctagcaaacatttaaggaagaattaatatcaattcttctcaaactctcccaaaaacttgaggggaaagaaatgctatcaaattcaatttacaaaatcagcgttattctaatataaaagccagacagggacactgcaggaaaagaaaattacagaccaatatccctgatgaacatagatgcaaaaatccttaagaaatactagaaatccaaattcagcagcacattacaaagaccattcatttaggtgagatttacccttggatgcaaagatggatcaccatatacaatcaataaatgtgatatactgcattaaccatatgaaagataaaaatcatatggtcatcttaatatatgcagaaaaatcttttgaaaaacatcagcatcttttcatcataaaaactcttaacaaattaggtatagaaagattatacttcaacattatagagatcatgtatgacaagcccacagctaacatactcaatggtgaaaaaggtgaaaaactaaaaatttttcccccaagatagggaacagaacaagggtacatactctcactacatctattcagtatagtacaggaagtcctagccagagtaattaggcaagaaaaagaaataaaaggcatctaaattgaaaagcaagaattataactgtctgtttctgcagatgacattttttatatagagaaaatccctgaagactccccccaaaaactgttagaactaataaacaaattcagtaaagttgcaggatataaaatggacataaaaaatcagtagtaatttatatactaataacaaactatctgaaaaagaaattttaaaaaagatctcatttacaatagcatcaaaaagaataaaatacttaggcatacatttaaccaaggaggtgaaagatctgtatgctgaaaactataaaactttgattcaagaggctgaagaaaacacagataaatgggaagatatcccatttttatggattcgaattgatagtgttaaaatgtccataccaactaaagcaatctacatattcaatgcaacccctatcaaaattccagtggcattttcctcagaaatagaaaaaaaattctaaaatttgtgtgaaaccacaaaaaaaagtcaaagcaacatggaccaagaagaacaaagctggaggcatcacaatacctgatttcaaaagatactacaaagctatagtaactcaaacatcatggtactggataaaaacagacatgtagaacaatgaaacaaaatatagagtccagaaataaatccatgcattttggtcaattaatcttcaacaaagatgccaaaagcatgcaataggaaaaggacagtctctttgatgaatggtgatgggaaaccggatatcatatgcagaagaataaaattggactcatcttacaccatatacaaaatcaactcacaatagattaaaccttaaacttaagacctgaatctttaaatttattagaagaaacaataggaaaaaagcttcttgacatagaactggccaaagatttttttgatatgacctcaaaacacaggcaataaaagcaaacctaaacaaatgggattacatcatactgaagagcttcagcacagctagggcaacagtcaacagagtgaagagacagcctatagaacaggagacaatatttgcaaacatacatctgataaaggattaatatccaaaacatacaaggaactcaaataactcaatagcaagaaaacaaatcactggattaaaaaaaaaatgaacaaaatatttgaactgacatttctcaaaaaaagacaaagggccaataacaatgtgaaaaaaatgcttattatcactaatcatcaggcaaatgcaaattaaaatcacaatgagataataacagcttatatttgtattctgtatatataggccaaacattgtttcaaaagctttatgtaaattaagccatgtaatccctacaacattccaatgaggtaagtgatattactaccattttatagagaagttaaataatttgctgaaattcaaacagcaaatcagttgacagtcaggattttattctaggaagattggtagtcatttcacaaaagagaaaacagaaatggccagtaaacttaaatatatactgtctcaaaaataatatgagaaatacaaaaagtgctgttacaccatgtgctagcaatgatactaagaaatgaaaatgcttacacatggctggtgtgaaaatacattaagatgacaagaaacatagcaaaatgcaataaatttgaacatgatatattttcatccaagcaattttactccaagaagacaagaataaaaacatattgtagcgtttttaacttgtaacaaaatactgcaaataatctaagcaccctggactggacaagtaaatggacaaaaaaaaaaaaacaaaaaaaacaaaactcatggcatattcataaaatggagtaatgtgctaatagagataatatatgaacttgcagtacctgtaccatttcagatatgctcaacaatatactcaagttaaaaacacataaggttgcagaatgatgctaattttgtaaaactaggaaatctcaaagcttattctactgattgattctgaaacaggaagtaaaagtataagaaacattcgtgagaataacagacatcaaaccaaggaatgtggctccctctgaacagggcagatgggaatctctattagagaaaagtcacagtacacttcttcttcatgcactaatgggttgggatttgaggttttaagataataggacttgattctacttgaaggatgaaaattttcttccaataagatgactttaccctatttcttgtgaagtgatctttcttgatctgctttgtattttaaaccaggctcacacccctttattaactgaagctgacttaacccgaactatctgaagctgactcaacccgaactatccgagatcacacgtaaatgttttccttctgatctcaacttttctccttatcgtggggcatggaaaggaggagatcgcagcagggaagtttttgttcttgttcacatgctaacaatggtaagcttcttaaaagtgaatcacagtagcatcacagagtttggacaggtgatgtaactaggagctacgaaaattgagtgccataaaagaatcatctttaaatactgaagtgcttctgtatgcttgaattatacagcatttcctgtttcaaagcagtttcacacaatctcatttaacacttttaaagtcatagtagttgaaccgagtatatcgcacccctgttacggctttttcttgattataggacaaaatgaaaagaacttttatgatctggctccaattatactttcaaggttcaagtcttcccatccggtaagatttttcttctttacaaaatgccccaactgaggcactcatgtactaggcacaggagactacctgtttgaaatatcccttgcttctgctggaaatgctgttcccacactgaactcatgtgccaactctcagctcaaaagtgcatgtttgtctctaccagtggactaaggaccagctcctaggatgggagcagtttcttactcatgtttataaagtgctatgcagaaaatagcagggctatgggaaagaaagagaccaggttagaaaagtcatttgaatcggatctgcatgaaaaaaggcactttagataagacctgatagcaaagggctgtaagaggagaaaagggcaaatcaaaggtaccgacagaacatattaagcatggcctaggctgagcaaagccaaatttaaacataattttgtatgttgaagcacattattttccaatatgttaatgtgtagccattctcacatacataataaagctaatggattatttattcaattgtatgttttgttataggagcctctgtcattaaaaagaaaatttattttcgtatctgggaaaagttgccaaggcaaaaaacacacacctggccatgcatctttagtttgttattgtttttaggtttatttgaaacttacaaagtgaaaaaaatcaatgacttctcagaaaaaggaaaaaaatagatgtaggtggaagagaaagaatacataggattataataggtttggcgaggatctcatgttgctgaagaaaacgagtcttgggattctttgtagtgggtcttcagaacaggcaaagaaatggttacgagtgaggataccagaaggagaagaaaactagaaatttgaatagaaagttgaacaaaatgaactttggataccaataaccttcagtgaatgggtgaagaagaaaaaacctttctctagttctgtttcaaaggcagtaatgaatagaatagcaaaagttaagcatgaatgaaatccatatttatctattttttgaaaggtaatgcatgtcttattttcactgcattatttccagagcataataatttcagcctaagttaactttcaatggtcagtctttgctgtccagcactgcattgctcaggagattcattaatcaatcaatcgatcaatcaatcagttccttctgtttctttcccacctggagctctgctgtcagagttgcacatgtgagtgagatgtagctcacttaggaatccatgcctgcagctaccctgggagctgactgccagtctctgctcagaggcccttgttcccacaggcatttgctctctgctgtgtaatttatagtttaagtcaaatgattccaaacacagtctctaacatttgggtaaaatctgtctagtactttcttgtgacacagaaacatagagggaaaatattgctatatttatgcaaatatagaatctttactctgaggcttttcttaaattcacagtcacccatatgccaagtggatttactgttcattactcagtgtctttactgtttgtaactcagatcacgttttccttcacaaagcctgcttactgaatatttgtgtgatgatttgaactcaattagctacttattgctaggttatattttcccctttgcagcaagcatgtcaaagattatacatttttttaacagattgcttttaattgtattagttgaagagcagtctttatatgtaaaatagtgaattatagttaagggaccaagggccattgtgtcttaagttttaattgttcaatagatcacctaatagtttttaaaatttttataggaatgtctgatcttatccacaaactttaacaaatgggcataaaaatattcctcccttaatttttctgacctgcactttttctgttttgtttttgtattttttattttgttggttactccacgtcattggttacttcatgtcaggattatttgcagcaatcttctgtccttaatatattgatgttttgggggcttctaacctaagctctattctttttccattctttaaattctccaagtaatcatacattcagttggctttgattactatgtatattaataattctggccaggcgtgttggctcacacctgtaatcccagcactttgggaggctgaggtgggtggatcacgaggtcaggagttcgagaccagcctggccaaaatggtgaaaccctgtctctactaaaaaatacaaaaattagctgggcacgatggcgggcgcctgtaatcccagctactcgggaggctgaggcaggagaatcgcttcaacccggcaggcggaggttgcagtgaaccgagatcacaccactgcactccagcctgggtgacacagcaagactccatctcaaaaaaacaataataataataataataataattccaacaccccatctctatgtccacccatttcttttctaaacttcaggctcaactgcttgttcaagctctccattgtttacctcacaggaatctcaaggtaacttgttcaacttgagtgtctctggacctcccctctctactggcttctctgcaaacgtttttcttggtgagtgcatctgctttcccagctgctcaaaccagatttctagggctctccctttgctgtttcccatccgacactccccatcctggaaatcacatagctttgtcaatttcatcactagaaacaccagcccctgcccttctgtcctaccggcatcactgtacagcatgctactctcatctcttgtagcctcattgcagtttacctccctgtttctaactgggccctgctccaatccactttccacactgtatccaagggatctttgtaaaattctaatctgattgtgccattcccttgttaataccaatcaataaattcccaaagttcttaagtaaatctaggtaagttgtttataaattccttcatgttatcatctccatttacttttttatcctcgtttctacccaaccaaaacacctttaagtgcaacagtcccacagttctaaattacattcattttttatggtatgctatttctcactttcagcatttctatttgctgttgattctgcccagaatgccgtggacagtcccctctccttgcctctcatgctcatttttaaccagcttctactcatctttatttttcatatatcgtctcagatatcacttcttctgagacacaatctttagggcctcaaagctgatctaggtgtccctcttatgtactttaatttcttgatcacatcaaatatagtactgaaatattatttttcagtgatgcttaacactggttctatttttctttttcttttttaatacttggaaaactttcactaactaacttactatcattgagtttcttgactggggtcccatactttttttaaaggtggatattagatttggaataacctcatgggtgattccaatacatctttggggcaacatctctgactatacattgagaaacactacttattgcaattcttgtttatttatttatattctacattagcctgtaagctagctctatcagggttgtgcctctatttaaaaatcttactgctgtatcccccgtacttatcaggcactttgcaagtaacaggaattcaacagatgatggagtcattgaatgaacagcttttgtcaatgaatgaaatgttcaggagcactttctttctttctttctttctttttttgacggagtcttgctctgttgctaggctggagtgcagtggcacaatcttggctcactgcaatttccacctcccaagttcaaactattctcctgcctcagcctcctgagtagttgggactacaggtgcatgccaccacacccagctaatttttgtatttttagtagagatggggtttcgccatgttggccaggatggtcttgatctcttgacctcatgatccgcctgccttggccccccaaagtgctgggattacagacgtgagccacagtgctcagctgagaaggagcactttcaagggaaggaaaataaccctagaaatgtcagatttgtgtctacataattaatttctactgttattccaggaatgtgaccaaaatttattagatctgtgcttaagaacagtaaagaacttaaaaattatcaaaagccttaaaatgtgcatacagcaattctaattctgggaatttatactggcaaaacataaaaattagcattagtatttaattaccttgagtttttataatggtaaaaattgtgaatgacctaaatgatcaataatagaggattgatttatgaacttatggtatatttatacaataaactataatttagacattaaatcatatttttaaatgttatgtgtatttttttaaaaactttaagtatattgaaggtttattacataggtaaactcacgacacaggggtttggtatacagataatttaatcgcccaggtactaagccttgtagccaatagttatttttcttaatcccctccgtcctccctcctccctctcttcaccctcaagtaggccccagtgtatgttgttcccctcttcttgtctatgtattctcatcatctagtgcccacttgtaagtgagaacatgtggcatttggttttctgtttctgtgttagtttgctagggatagtggcctccagctccatccatgtttcagcaaaggacatgattgtgctcccttttgtgattgcatagtattccatcgtgtatatgtaccactttttttattcaatctgccattgattccacgtctttgctattgtgaatagtgctgcaatgaacaaacacatccatgtatctttatggtaggataatttatattcctttgggtatatacccaataatgatattgctgggtcaaatggttgttctctttttagctctttgaggaagtgccacactgctttccgcaatggttgaactaatttacattcccaccaatggtataaaagtgttcctttttctccacaacctcaacagcatctgttattttttgacttttagcaatagccattctgactggtgtgagatggtatcacattgttgtttgaatttgtacttctctaatgatcagtgatactgagctttttttcatatgctttttggctgcatgtatgtcttcttttgaaaagtgtctgttcacgtcctttgctcacttttgatgggattgttttctttcttgtaaatttgtttaggtgtcttatagattatgaatattaggcctttaacaggtgcatactttgcaaatattttctcccatcctgcaggctgtttactctattgatagtttttctgtgcagaagatcttaagtttaattagatcccatttgtcaatttttgcttttgctgtaattgcttttggtgtcttcatcatgaaacttttgccatctcctacgaccagaatggttttgcctaggttgtctttcagagttttgacagttttgggttttacatttaagtcttcaatcatcttaagttgatttttgtacatggtataaggaaggggtccaatttcaatcttctgcatattgctagccagttatcccagcaccatttattaaatagggaatcctttccccattgcttgttttttgcagctttgtcaaagatcagatagttgtaggtgtgtggccttatttctgggttctctattctgttccattggtttatgtgtctgtttttgtactagtaccatactatttgggttactgtagctctgtagtctagtttaaagtggggtaacatgattccttttttgtaatagttttagcaggaatagtaccagttcttgtctgtacatctggtagaattcagctgtgaatccatctggtcctgggctttttttggttggtaggatatttattattgtaaaatcatattttagaagtgtatctactgatatgcatttaataatatataatagacaaaaaagattaccaaaaactacacacataatttcatttgttaaatttatattttatacatttaatatattatataagaaacagtgttcactgatatgtacaatcatattcataatttttatcaccctagcataagataattttgtatattctctttctgttttttggttttagtaattattatttttttactctgaaagtgtgtttcacaaattacaaaatgttcctaaatattaaagtatgtggaaactaaagagaagtatttgctcaaatttttactgaaatcttcttcatccatcacttcccactaacccagtgtttttctcaggaggcccacacaattgcctattatcaagaaaagatactttcaaaaaaactgaagggagcggttatatgctgtggcacagcaatttcaatataagttgtggatatttcccaaagaatagtgtcttgttcatggaaatgcactcttgcttaatcagatgatgacctgggatatggtgttaactagattaaaaaaaaggccatctgtgcctgaggctcttctggtaggaaaaacttggagcttaaattgttttcattactagaatttgcatgacagtggtttttagtaacatacaaagaaaaacatggtacttaaaaatactatcaaaatacttttcttactttaaaagaaaaaagttctacttttttttttttttttttttttttttttttgagacggagtctccctctatagcccaggctggagtgcagtggcgcgatctcggctcactgcaagctctgcctcccggattcatgccattctcctgcctcagcctcccgagtagctgggactacaggcacccgccactgcccccagctaattttttgtatttttagtagagacggtgtttcactgtgatctcgatctcctgaactcgtgatccgcccgcctcggcctcccaaagtgttgggattacaggcgtgagccactgcacccggccaaaaagtactattagatagtgttactaaatattaaaaggaacattgtaagaattcttacacatcttatagtgtgaggaaaatatcctcttattcttaattgtgttattttagacttactgcctttacattttaaacctttcctgacacttttttttattatgaatacattagtgttatgtactttaccaaaattattgctttagggtaaaaacactattgaatagtttagactaaggaattttgaaggctcattagttttgttcatataaattgcctatgaaattagggattcctgaaaggatagtggtatcttttgagtcaattgtgttgtcagaaataataataataataataataacttcacaagcccatgcttcggatcctagctctgcagccattctgtgacctcacaggcgttggaccctacagtcactgctatagaagtcacatctgcatcacagaccttagagcaatggttgctccacacaaacccacattctggaccccggttccataacagctctacatgtgccagtgcctacaacacaagagccactactgctttagaagcacccatgccctggaccatacagaaactataggtatccacatgcctttgtttcagaccctggctttccagctgttccataagcatctgttcattgcacattgagaccaacactggagccggggtgcctgcatgttaagcaccagtgccactgccaccatgaacataaccatgaaccaaacccaacaccaagagggatccccttggccatgacttcccacacgggagaacaagaaatcaggagggctcctaccaccttcaccaactcttaacccaacagccctcaccaccactgtggacatctgcagccttggccactgaggacccttgcaatcttcaacggatggaaatacacagagactatgcttttgtatcttcactggagctggaattgctgcatcccacccatcagtaccctcataccacctgtaggtgaaggactttcctcacagaaagtagcctgtaaattctggaataggtgactgccccagcaaatatgcagacatcaatgcaagacaagaaaagcagaaaacatcaagaaaacatgacactaccaaaggaaaaccataatttccagtagccagtcttccataatggagatctacaaattgtcacagaaagatttcaaaataaatgccttaagaaagctcaagctacaagcagactcaatgatatcaagaaaacaatacatgaaaaaaatggggtaaataaagagatataaataattttcaaaaacaataaaacaaattctgaagctgatgaatacaatgaatgaaatgaaaaaaatacaacagtgacaaagcagacttgatcaagcagaaaaaaaatttgcgagctcaaagacaggtaatttgaaattacccagttaaaggaagaaaaagaaaaaaagagtgaaaatgagtgcagaaagcctataggatttatgagataccatcaagcagcccaatttacacattatgataatgtaaggagaagagagagaaaaagaaataatatttaaagaaatagtggctgaaaattcctgaaatctgaggaaatatatatacatcaggatacattaagcgcaaaatttcccaaacaaatttaactcaaagaggtctccactgaggcacattataataaaatttttaagtatcaaagaaagagagattttgaaagcatcaagagaaaagagactcttcacataaaggggaaatttcattagactacagatgatttcttagcagaaacttttcaggccagaagaataggctgataaatcctaagtgctaaaataagaagagaaaaactaccaaacaagaatactttactgagccaatctgtccttaagaaatgaagaagagataaagactttcccagaccaaaaaacaaacaaacaaacaaaaaacaaatgagggagtctgttaccacaagacctgccttacaagaaagttctccatgctgaaatgaaaagactttagtaagatgaaaatataagaaaatataaaaatcattagtaaaaataaatacatagtcaaattgaaaatattcaaatactataatagtgataggtaaatcactcttaactgtggtataatggttaaaagacaaaagtattttttaaaactatagttaatttttcaataaacatacataataaaaatatgtaaactgtgagatcaagaaacataaaatatatttagggggagtggaggaaagaaagggcagagtttttgtatgtgattaaggttaacttgttattagtataaaatagactgttataaatctaatgtgttttgtgttagcctcctggtaattgcacaggaaaaacctatagtagatacagataagataaagagtaaggaatcatcagatatcactacagaaaatcaataacaaaggaagtgtacaagagaggaagaaagaagcaaaagaactacaaaagagacagacacaattgaaaaaaggcaatagtaagtccatgcctatcaatacttactttaaatataaatggattaaattattcaatcagaagacatagagtggataaaaataaacaaatgtgcacatatgcacacacccacacaaaccaaactatatgctgcctacaagagactcacctcagctttaatgacatttataggtcaaaagtgaagggatggaaatggaaatggaaaccaaaacaatggagaggttgctatacttacatcagacaatacagactataagtccaaaactgccacaagagacaaagaaggtcattatagacagacaaaagaatcaacaaatccagagtatataacaattgtaaatacatacgcacacaacattgaggcacctacatatataacataaatattaccagaactaaatggagaaatacacaacactacaacaaatagtaggtaaattcaacaccttcactttcaacaatgaacatactttccagaaacaaaattaataaacacattggatttgaactacactcagaccaactgtcctaacagacatatgcagaacactccatccaacagtaactaaatacacatttttttcaagtgcacattaaacatcctccaggacagatcatagttgaggcaaaaaaaaaaaaaaaaaaaaataggccatagcacaggtaaaaaaattgaaatcatatcaagtatttttccaaccacatgatatgaaactagaaatcaacaataagagaaaaactaaaaatttacaaatatgtgaaaattaaacaacacactcctaaacaacaaatgagtcaaagaagacatcaaaagggaaataaaaagattgtaaaacaaataaaagtaaaacataccaaaacttatgggatgcagcataagcagtacaggaagtttacagtaataaacacctatattaagaaaaaagaaacatctcaaataaataacccaactttacaccttaagaaattagaaagaacaatctatacttaaaatcagcagaagaaaagaaataataaagatcagagcagaaataaatagatacttaaaaaacaatgtaaaggatcatggctaggcacactgactcatgcctgtaatcccagcactttgggaggctgaggtgggtggaggtcaggagttcgtgactaacctgactaacatggagaaacccaatttctactaaaaatacaaaattagccaggcgtgtggtgcatgcctgtaatcccagctacttgggaggttgaggtaggagaatcacttgaacctggaaggcagaggttgtgttgagccgagtttgcaccattgcactccagcttgggcaacaagagagaaactctgctcaaaaaaagaaaaaaaagtgtaaaggattaagaaaactaatacatgttttttgaaaaatttaaaaaattaacaaactttcatttaaattaactgagaaagaaagagagaagacccaaataaataaaagtacacattaaagaggaggcctttaaatgatatcacaaagacacaaattactgaaagagactattatgaacaattatataccaacaaatttgataagctagatgaatttgggtaaatttctagaaacacaaaacctaccaaaactgaatcatgaagaaatagaaaacttggacagactaataataactaaggaaatttaaccaataataaaaaatcgctcaccaaagaaaaacccaggacctgataaaatttactatttggtagacctcactgttgaattcaacagtgaattctactgaacatttaaggagaattaatgtaagtcactttcaaattcatccaaaaaattgaaagataaagaaaattttaaactaaggctaatattaaggtattaaggctaatattaccttaataccaaagccagataaagacacgaaaatataaaattacaggccaatatccctgaggaacacagaggcaaaaatccttaacaaaatattagcaacctgaatttaacagcattaaaaggatcacatacctttatcaagtggtatttatctctgagatgcaaggatggttcaacataccaaaatcaataagtgtgatacacattaaccatatgaaaagtagaaatcatatgattatcttatagatgcagaaaaagtatttaacacaattcaacattgtttcatgataaaagctctcaacaaattggatatagaagaaatgtatctcaacataacacagtttatatgtaacaagctccaaaataaccgtatactcaggagtgaaaaggtggaagtttttcctcaatgatcaagaacaaggttgcccactctcaccacttcaacttaacatagtactagaaggcttagttagggcaattaggcaagaaaacagaaaaaaaaaaaggcatctaaattagaaaggaagatgtaaaatagtctcctgttgcaaatgatatgatctatatatagataatcctgaagactccaccaaaaacactgttaggactaagaaacaatttcattaaggtttcaggatacaaaagcaacatacaagaggtagtaatatttctatacactaactgaaactgcttgaaaaataattttttaaattccatttaaaatagcatcaaaaataatatatttggaaataaatttaaacaagaaggtgaaagatctgtacactgaaaactataaaactttgataaaggaaattgaagaagatgcaaataaataaaaagatattccgtgttcatgatttggaaaaattgatgttgttaaaatatctacactatccaaagcaatctatagactcattgcgttccataccagaatttcaatgacatttttcacagaaatagaaaaacgattctaaaatttttatggaaccacaaaagacccctaatagctaaagcaatcttgagcaagaagaacaaacctggaggtattacactttctgatttccaattatgttacaaagatatagtaatcaaaacagtatggtattgggataaaaattagacatatagatcaatggagcagaatagagagcttagaaataaacccacacatatgtggtcaactaattttccacaaaggtgtccagaaaaaacaatgaagaaaatacagtgttttcaataaattatgttaggaaaactggacatccacatgcaaaagaatgaaattagacacttatcctacaccatatagaaaaatcaactcaaaatggagtaaataattaaacttaagacccaaacccttcaacttctaacagaaaatacaagggaaaaactccttgatattggttctggctatatatgtattttttggttacaacccaaaagtttcaggcaacaaaagcaaatataataagtggtactacaaaacactgaaacatgtttacacagcaaagaaaacaatccagaaaatgaaaaggtgacctacagaatgggggaaaatagttacaaaccaattatctaataaggggttcatattcaacatatgcgatagcccctcaacccccatccatagtttcactttccatggtttcagttacccatggttaactgcagtctgaaaatattaaatgggaaattctcaaaataaacagtttataagttttaaattagcatgatgaaatctcactctgacctgctccattctgtctgggatgtgaatcatctttttgtccaacatatccatgctgtatatgatattcatcttttaatcatccacatggcctgctcctgacatccaaccagtaacattatcatggctcaaagatcaggaacacccacagcagatgatcctccttctgacatatgatcagaagatcaatagtagcctaatgctacatcacaatgcctgcattatttacctcacttcatctcattaggtaagcattttatcatctcacatcatcataaaaagggtgaatgcagcgcaataaaatatgggccaggcatggtagctcacacttgtaatcccagtactttgggaggctgagattggtggatcacttgagcccaggagtactagaccagcctggccaacatggcagaaccctgtctctacagaaaatacaaaaattagccaggcatggaggaacatgcctgtaatgctagcgacctaggaggcaaaggtgggaggatcgcttgaacccagaaggcagaggtttcattgagcccagatcatgccactgccctccagcctgagtgacagagtgagactctgtctaaaaaaaaaaaaaaaaaaaaaaaaaaaatttagagaccatattccatattcccataattttaattacagtatattgttataactgttctactttactgttagctattgttcatctcttactgtccctaatttataaatcaaattgtatggtaagtatgtatgtatagagaaaaaagcatagtgtatacagagtttggtactatctgctgtttcatgtatccactataggtactggaagatatacccccagaaaagtagagactactctataaagaacatatataacccaatagcaaataaagcaaatagcccaataaaaatataggcaaaggagctcaatagacatttttccaaagaaagccatgcagatggccaacaggaatataaaaatgtgctcggtgttactaatcctcaggaaaatgcaaattaaaacaacaatgagatatctcatagcattcaataagacagttattatcaaaagtcaaaagatcacaagtgttgttgagggtatggagaaaagggaccccttgtacactgttggtgggaatttaaattgaaaacagtatggaagtttttcaaaaaattaaaaatgcaattaccatatgattcagcaaccccacttctgggtatatacccaaaggaaataaaacgactatctcaaacagatctatgcactctcatagtcatagcagcattattcatggtcgctaagatacagaaacaatctaactgtccatccacaaatgaatgaataaagaaaatgtagcatatatatatatatatatatatatatatatataatgaaatattatttagtcttacaaaagagggaaatctttacaacacaatggatgaaccaggacatcctgctaatttaaataagccaggcatagaaagacaaataaatattgcatgatctcacatgtgaaatataaaaatgaataattaaataaacttatcacctcacttcattcctatttttctgtatgtggtaaaaacatctcagatctatctattcttttagcaaatttcaagtatacaacaccttattattaatttatagtcatcatgccatacactggtatgcaaaacttatttaccttaaagcttgcatcttttgaccaccatctcacaccacacacagaaaaagtaggtatgaggtgaggtgatggatatgatagttttattgtggtaagaatttcacaatacataagtatatcaaagcattatattgtatatttcaaatatacacaattttgtcaattatacctcaataaagctggaaaaaagaaatctaatagctccacttaaatgatgttcagcttcaacgactttgtttgccaaaaaattttgttaaaaggtgttacagtaataatcatcttctttaaaatgagcactaaaactcagaaaattaatatagatgtacataaaataatgtcaatttcttaaatcctagagcatttggtttttaaaacaagagctgtgatttctattttgattggggctctgataaaagtcagccagattcatttgctgcataaattactcacagatcattaacagaagttttttctgcagctgcaataactcatccaggctgttacagaactatgtaactcactgcaggcagaacttcctaaatgtcaacttaggaaccaaagaggtttcatggatctatatgaagctttagtaccatcctgggttttgaacacagacactccacagacctgtgactgtatttacagtagcataatgattcagttgctatctaacatctaatctccagcctctaaatatgccacaaatgccactgttcactgcttatgtgctagacttgcccaccttgtctcatacctacttttaactactcttctttatgcttctccccataattttatgctaggcagtcacctccattggaaatatttagaaagagccaaaaatatatttaaatgtaagaaactcaaggaggaatgcacaatcaaggaggaattatgaggaaatgagtagggatgcaaataattcacagggtactaaatattcttccatcttccaatttccctttatggtacttttccatattcatcctcaacttgagcttccaagataataatgcaatagcaattcatatccctagattatccacagataaaatagactgtagcagctgctgtcctctgcccaggtcccccttcagtcttcaaggatgtagtccctcagctgcgtagagtgctatggctgacagtcctcaatgatcacctctctcttggaattgcctgttggtggagagagctgcctctcttgatgtcacaatcctttcctaagggaaatctgtttccaatgcctgttgaggaagcttggcccctcactcactcaggtgcagctttcaaagacagctatgagggggaattctctcagtgtgcagggcttcacgcactacacttggtcatcaaattcatgttgaaagagatgcagcctcagcctcagtttggaatatacacagacgggtaggtgctgaagggcacagacagatcatcagaggcctagtgggagagaaattaggagatcatagacaaggatatctggagtagtgttgtgtagatgacactatgggagaagacacaatgtgggaagatctttcagttgcaggttaacacctaccagaaatcatctattttggaagaggcactagacagccaagtagatggactgactcagccacttgatgccagccagtttctgtcattggccattccagtgctgctgaaatgaacacatgaaaagagtagctttagtgtcagagatgttaggttatgctcgggcccaacagcatgggctcccattcatcaaagctggtctagctccaggtgctgccgaacagcaaacttgccagtaacaaagatgacatcttcatccccaatattgcatcatttcttcaggagatcatcccatcactaagcggcaagttcaccacagtctacttctttcatcttgccagggtcagtggttcatttttgacagtaacaaattctgaacatgaatttgctttttctgtccccatggtttcaggcaacactgttatctgaatgcttgcagagtgtcagatccaacaacagcaatttcacttataattatgtcaggcagagggacaaaccttaaaaccaagcaggtccatcagtgggtccataatgacaggatctgctggtcatatcacaagccacaccactctattgcatcaacctgatagagtgctgaaacagcctgttgaaacacaacggaggtgtaggcccagacatgcttccctgtgagaatgagacagcactctccaggacatagcatctatcctgaatcaatgagcattcgcgggctctgggttcccgataaacagaatacatagatgagaaaccaaagtctagaagcaagagtggcctctgttaccaacattcccagtgacccactggagaatttgtgcttcttgttcctgcaactctggggtctgtgggtttaaagatcttggttcccaaaggaagaacatttctgccatgaacacatcatcatttcccttgaatctaagctgtggtagcttcctggacacattaaatttctcatggcaaaggacaaaaggacaagaaaagcagtcaccatcctaacagaggtaatggattctggccctcctttatgccccacctcaggaggaggagctgctgctacagggaggaatatgctggcaatctacctttggaaagtccttgaccaattgtttcggtaaatggacaagtgtagcggccccagcctgaggcaggtatagtgcccagggtttcatgccagtagatgacccatccagaagagcagaggtgatgtctgagggtgagtagaatctaggatggacagtagaagagggagactgtgtactaattgtgggtcttgagacaaaatgcagtggtcaggcctgtaattttccttcaggatgctcactggaatccctggagaggctaccccaacatttaagtaaagaagcagaacaagtacagcagggaatgagctatagtagacatagctgagctgcccagattctcccgcaggattgaagggcctgttcctcccctttctcctcctggcactggtagatatcagcccagagatgtgcagtgtactctgagcacctcgagtttggggcttgacttacagtgccatggtgcttaacacacttgaagagagggtgaacgactgtgtgatagaatgactgttttaattacagcgtagcagggtgttgactcttctcttttggctttgagacaatgttcttgttcaagtcatgaagtcacctgtctttagaatcactaagacttggtccaagataacttagttgactcaaacactacattaatcatgttatgtgacctatgaaatagtctgctggaaagcaaattatgtcatttcattaaatcatcttatcagggatgaccacaaaacccatgaaataagccactttttcttaatttctttcatagatttcatattattcataaacaaatttttaagaaagtaatttaatttgggtacaaaaataattatatattaagatacactggattttatgttatgattggaaagtcatattcatctggacgcatttaggtagcagctgtaggatcttatgtaagtttctgaacttttctgtattttaatttctgggccttgtttgttaaatataccttccttttaaggttgatgtgaaaattatatgagtcagtaaggcacttaaaatgtgcttgacacagagtaagccgtcatgttattattatttttgaatgcctatcgtatgtcagagacaataagaaggtttctcttggataattgcttgtacacacatcatctcatttaatccacacaataaccctaatgtatagctgttcttcatgttacttatgaggaaaatgagggccagaaaaatgaagcaatcggctcaaggtcacacagctagatagtggccatgctaaggcagcaaaggtcaaagctagaagaaacaatcctgtaggtaccttagcaattcttcacagtctttcttttcttggctttattatgactctttccatctggccatgtcatctgtttggcctattctccagaagtcaagagattagatctgaatctcagcagtcttgtccttgatgcaatagagagctgaaatcctctctcagaatacatatcaatataggccgggcacggcggctcaagcctgtaatcccagcacgttgggaggccgaggtgggaggatcacaaggtcaggagatcaagaccatcctggctaacacagtgaaaccctgtctctactaaaaatacaaagaattagctgggcgtggtggtgggcgcctgtagtcccagctacttgggaggctgaggcaggagaatggcttgaacccaggaggtggagcttgcagtgagctgagatcgcgccactgcactccagcctgggcgacagagcgaggctccatctcaaaaaaaaagaaaaaagagaaagaatacataacaatataaagcttgattcttccagcaactctgggaaccaactctaagtttgctgatgaaatacctgttccagcttacctctcaaatattgctctctgaatattttttgttgaattcaaagaagtttgcatgcttttatccattcgagaacaaaattttctgcaaatacacctgagacatacaatatatgcatgtggatttttttactgaaagcaagtttactgctctatccttccgtttttcttcaaagtatcaagttgtactgaagtttgttacctcagtgctgaatgccattttcttttttttttttttttttgagatggagcctcactctgtcgcccaggctggagtgcagtggcacgacctcagctcactgcaacctccacctcttgggttcaagcgagtctcctgcctcaccctcccgagtagctgggactacaggcgctcactgtcatagccggctaatttttgtatttttagtagagacagggtttcatcatattggccaggctggtcttgaactcccgacatgaactgatccacctacctcagcctcccaaagtgctgggattacaggcgtaagcccctgtgcctggcccatttttatatcataaaataaagctacatatttatttacctatacttttcaaagtattgtcacatagttattctatctaaagcaagacttaactttcaatgttcaattaaatcattcactgcattgtgtttatttaacattatatcaccattggttcacattgtatgtcctcctttgaactgagtcaaatattaacagtaaaaagttatctttttgataaaagttttaagcacactaaataggaaatttataatgaatctcagttatagatctgttaaaatatgtttttaaaggtatatttcaagttttctatcagagaatatagcaatctgatgagagatatctagtgcctctttattaatagaaaatgactgaagcttagtctcactcttgataaaatcataaataattttttgaaaaccacatacagataataatgaatgtctacatttataagaagtagaataatgttttgttatatcatcatctattagaaacataaaattttttaaactacaataactgtaggtccatggactgagttgaattatttcattagaaaataattttaaaagaaagccgattcacttatcaacataaagtattgtgaaatggagttaatatcttacttgtaatatttctagactttttaaaagggctaatattaaaagagaaagagagagagagagagagagagaagcttgattagccatcagggaaatgcaaatacaaaccaaaattagataccacttcacaccgagcgtgaagtgaatggctacagtagaaaagacagacaatcacaagtactggtgaggatgtggtgagatcggacccctcatgttctgctggtgtgtatataaaatgtgcaacttctttggaaaacagtctggcagttccccacacagttaaacagagttaccacatgatcaagcaatttcactcctaggtgaatacccaagaaaaatgaaaccatgtgtccacataaaagtctgtacacaaatgtatacagcagcattattcatatagccccaaagtggaatcaacccaagtgtccgtctgatgaagggacaaacaaatgccctcattcatactattaaatggaatactattcagcaataaaaaggaattcagtacagatacttgttacaacgtgaatgaatcttgaaatcatgttaagtgaaagaagatagtcaccaaggatggctgtatgattccacttataacaaatgtacagaataggcaatttataaagacagaagctagataggtgattacccaaggctggtgaaatggggagatttaggagccctgactgagtgcagaatttattttagagatcataaagagtgttttaaaattgactgtgatgatggctgtacaactctgtaaatatgctaaaaataattaaattgtattttataagtgggtaaattttgtggtgtgaagattatatcttaacaaagttgttaaaaaaagagaaacagtgaagtgtgtcatacttaaatgaaaaaaatcttcatttccctccaaatttattttaaaatcttgccaaagtgtagtatatgtaataaattgaacgatgaatagtactggattttaatcacactttactaattcttaatcaaaatatatgctagatgaatactgttcaatttgtaattactttgcataggcttttaaatagtactaaattactctaggtatgaaaagtctttgaaatgaatattccacctatagaaatatatcctttggaaataattaaccacatgtataattatttcacttcaagaatgttcactaataatgtttctgataataaaaatttaagataatcaaaatgcccaacattaagtattagtttagataatttcacattatttaaagattcaatattctccccttttaaaaaagctgtgaacgtacctattgaaatgaaaatgcttataatatggagtttaatgactaaaacagttttaaatgagcatgtaccgtgtgatcatttttcttaaagatatgcatggaaagttatctattaatagtaatggttgtctctgggcagtgtgagcatatgattatggtgtgtctccttttattcatctatacttacaagtctttcctataatgagcatctattgatttggtaacatgtaagatatttttaattttaaaaaataaccaaatcgcattttaatgttaacagcaagcagcacaaagtactatgttgctccctgaatatttcaccagaagggttaacttacattaccctggaaggaagacaataagaaatggtgagcctgatggaatagagagagaggctgaggagtagttctacctgcctgtttttccatggtgacagtggaatattaatcacagatggatgagacttaacattgctcagactatcattagctgttttcatcaatcactgtccagttattgctaatcctctaccattctcatcctgtggggggtggaaaatgacagactgcgtgtatcaagcaaggttcccaggtacaagcaacaagaaaaaaaaaatgaagttggctatgttaagataaatgaatcaactggaagtatgtagagggctcagaaaacaaaggtgatgtaggggaacctgcttaaacaaccagtaagaacaaaagaagttctagaagccaagttgcaacaaattcctagatggaatgccaatacccaggaccactcttaggcccaggcaagaagggccattgccccagctctgggttttaaagaaactctggccctgtggccttgtccctaaggcaagagtctatgaagttgaggatgcatgttacccagatcccaagccctgccttgagaccatgttgggacacgtatgaccccaggattgtttgcacaagtagtccttaactcactcaaagcctatgcagtcctcttcacaggctccacccactcgaacagaaactgcatacaggtggacctaggagtagccaacatgcagctttctgttgggggttatggatgaagcttagatctataggtcaggctgtccacttgtgtaggcacaaatttcttacagagcaaaacacagccaagagcaagaatctaggggaaaagggctcgcatactaagaccaaacactggaggccagtattcccaagcttccagaatccagcatgcaagccccagggagctaagaattctaaactcaaacatggccacctgggtttttatgaaggcacatttttccagggagtagaatagatatacatattatgtatatgattaagcagtttttaagattaacctacaacttttaaatatttagttttatggcatgtggacttccatgtatacagttgggtcttgcaaatgtcatcattgccagacaaacctagcaaagtctaagtatatgctggtcactcctttatctttgcatttcttttccctcaagatacaaagacccagaaaacaaatatattcatcccaggtcataagtcacacccttgctgccaggtcttgagagagggggatatggcctttggcagcctctccagtgggaggcagggccctattgacccacaggaacacacataatggcgatgacctgctcttcttctattaataaggagagagaagtgcatgctggacagccaaacaaggcaaaacccaaagaaatatgcattgtattgggaggaagaaggccatccttactcaactagctatatgaggtcaatgacattaagcctctttttctcccttataaaataaccataaaaatccctacttcattggattgttaacaccattaaaaagataatatgtgtgaaaaaatgctctgcaaactgcaaagtgctatacaaattagcatattagtgttatactcttgggagagctctggcagttgctaatcaagaattaagagaaatatgctaattagaggagacacctgacaatgatgaagataggtggcaggtaagaccccacctgcttcaatgcagccctattcaaatctttacattttgtatgctgctactcagccccacattacaataaatatctcccacataatctgcacaatttccctacaataaattgtcaagcttcatctggtcatccctataaactcaatatactctaagcaggttgttaagtacattcaaggatttcacaatgaacagctgagatccagttatcattaaaatgaagtgctgacactggaataaagccacaagaaagtgtttactgctactgctgctctggaattataatcatttctttgcttggcctttagaggactgaatcatctgatgcatatctatcttgtttagtaataagatttgaaacctaatgttgaaatgtccatatctatgtttattagaactagaaaccaggtccacattaagctcacaaaaccatagcttctttattaattgcctacatttattatctatgctggctgcacacaattttatgaagtgataactattttccagtttaacagagtatgagctgcaaagtggagagtttgggaagaagcttgacatttagtaggaagcaaaagataagagtgaagtgttcctctcccctctccccacggtctccctctccctctctttccacggtctccctctgatgccgagccgaagctggactgtactgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgacacaacctccacctcccagccacctgccttggcctcccaaagtgccgagagtgcagcctctgcccggccgccaccccgtctgggaagtgaggagcgtctctgcctggccgcccatcgtccgagatgtggggagcgcctctgcctggctgcccagtctgggaagtgaagagcgcctcttccaggctgccatcccgtctaggaagtgaggagtgtctctgcccggccacccatcgtctgagatgtggggagcacctctgccccgccgccctgtctgagaagtgaggagcgtctccgcccggcagccgccccgtctgggaagtgaggagctcctccgcccggcagccgccccatctgggaagtgaggagcgtctccgcccggcagccaccccgtccgggagggaggtgggggtcagcccccgcccggccagccgccccgtccgggaggtggggggcgcctctgcccagccgccccttctgggaagtgaggagcccctctgcccggccaccaccccgtctgggaggtgtacccaacagctcattgagaacaggccatgatgacaatggcggttttgtggaatagaaaagggggaaaggtggggaaaagattgagaaatcggatggttgctgtgtctgtgtagaaagaagtagacatgggagacttttctttttgttctgtactaagaaaaattcttctgccttgggatcctgttgatctatgaccttacccccaaccccttgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttacctgctgaccttccctccactattgtcctatgaccctgccaaatccccctctgcgagaaacacccaagaatgatcaattaaaaaaaaaaaaaagaatttgacaaagtaaaaaaaaaaaaaaaaaaaaaaaaaaggagatttactaatgtggaagattaatatggaagattcctgctatatgttctttttttttttttgagacagggtatctctatgtcacccaggttggagtgcctgggtgcaatcatagctcactggctcactgcagcctctacctcctgggctcaagtgatccccactgcctcagcctctcaagtatctgggaccataggcatgtgccaccatgccaggctaatttttaaatttttttgtaaagatagaatcttgccatgttgcccaggctggtcctgaacttttgggctcaagcaatcctcccacctcggcctccaaaagtgctagaattacaggcatgagccatcatgcctggccatgttctctattaaataaaagccttccatctctttcttcatttcagccagttaaattgagatctaaaggcttgaatttactatttaatgctacctaatgacatttcagagactggctataaaaaagcaagtgttgaaaattaacaaaaacgtctctacaaaggaaatgaaaatgttccctcttccttgaaccaacagagagagaaatatcctttcactttataaaatgaattccaagactctgatttgatgcagcgttaaattgaaaacatttaggaaaatatcaatcttgttttctccatttccatttgtgcaaaatggagacttgctgactattcataattatcaacttactctgtactgttttctattaatgtgaattcattggaagtatactttgaaaaggaggtcatgtaaaactcttgtcctgggaaaattactttcaaaattaaaaaaaaaaaaaaaagagtgaagtgttttgatttaggagaagatgtacatccaaagagacttctgtcttaggaaacatgagaattttgctgtaaagctcaacctagatgcaaaggagactaaagacaagcatcccagacaattatagaccaagcattgggaaaggaataagttgggactgactcataagacacttagatgaagctaggacaatggacattacgttagctaaccctgaatttgtgctggaaagatttgacaaaacctaaaccttatctatttcttataagtgcagagaacaaatagttcaaaacacagtatctatagataactctgtaaaacaaaacaaatttgttgtttggttaattctcctcaagacataggttgcaactgatattaaatttcttctcatagactatcgatttacagcaatggattggtcaaggaaggataaagaaacttggaaagaactatcatgatacctgccctgagaagccaaaatttggtttaactttgtgttgtttactgtttggttctataaaagctaagtttataaaatattgtatgacaggtgaatttaaatgttactaaccatcttggatgtcctgctcttctgctgtacagcaataaagtctctctaaatgcaatgtttgggacagagttgctctgggaaatatagtggtttgaaaggtggctattgtacccaagatgaatatgttattatctcattggacatagcatcaaatgttatttatgaaaatgcttatcactgccacaggcttctggtctatacccatgaagacatcgctcaagcatagcacctcaacagagtgaaaagtgcaacccaatgctatagtaaaggcatcacctaaaacttccttgcctcagacacctgaatggcagtgtcttcactcaggtccccactcaaatgtcaccccatcagcaatgtcttcaccaatagcactgtataaaatggcaagtccactctccaaacaagtacttcttctcctttctccacattatttatctccaccccactatggccatctaatgaagtctgcatgtatttgattctacattagttttccctctctccctatatttttgcatgtccagctccatggacccaaaagtacagtctgagcaagatgtttgaaaccacctttgcaaaaattatgacattgaaagtaatcggacatagctgaatccatcttgcttctaacctcacatgctgcccttgttcacttctaggcataggccaagctaactatgggaggaatttggtttatagtttaactttaaacaaagacaaccgtcctttcctgaaactaactcccttcccaatggctcctatagatactactattgtaaaacctaacattggtgtttgagctatttttttgaccctacattctgatggatcagctggcaccacctggcctgataacccataccaagaaactggtttatctggtcttgtgaccctcacccaggaactgactcagcataagaagacagcttccaactccaatgatttcatccctgacccaaccaatcagcatccccattccctacgcctctgcccaccaaactacccttgaaaaaacctagcctctgaattcttgggagggcagatttgagaattatctcccatccttctgcttcgttggccctgtgattatcaaactctttctttgctgcaaaacctgctgttctcagtgaattggcttttctgggcagtgggcaagaagaagtagtcaggctgttacaccttcacagcactcagtgatggttcttagatgaaagtaacaacttataagcacgtggatctggatgagtccagcatgtcccgagatgtgtagcatgtttgcgcagtagaacaaaggcttcagggatgtctggttcacatgtggcagtcaaaaaagtcacaatattaaattataaaccttcttccttccccttcctttttttcctttagattctcaataagattctattttgaaataaaatagaacaaaggctgatgtgctactaacaaaaccttttgaaggaaatttcaaaacaagagcaagttaaggcatgccaatttattatcatactcttggattaaattcccactttttgcctgtattttcacatctgtaatttggaggagtaacttcatgggttgttaaaacagcaattaataactgtgtgttttaagtgttagttttaaatattactttctatgtagcaaaaagatttctgatagtgctataattctccaaagagtagggtcctgagtaaaacagaatgtcactgttactacttgacgattgtcttctgaaataacatattcaaacccatgtactttacttactatgaagcattttatggctttgacgaaaccatttcaaccccattctttcccatgttttaagggtttttttaggtagctcaaactcagcacatccacgaaatatctcatcatctttccccccacactctgtgtctatacctgaattctctttgatgaatagcaaaatttccttcaagttactcttaccaataactttggaaatatagatttgtgaaaggaaaagaaaatctcaggaccccaaactctctgtcaaagggaaagcaagtcacacaaaaaaactgccttcctcttgttcccaagcagacaactgtaatttcacatgtgaaatgtagatttgccaagccaggaaaagacatacttgaccttttccaccactcctctcttttcacatgtcaaacaaagatttttgtgagtgctaatcaaagcctcgcaagaatgtaatgaccacactgcctaagttctacctcccccccacttttttttctttcctccttcccctcctgcctgctctttccccctgtagtattgaagttctcaaaaccttctttggaaaaagcacagtccacattccaggcacatcctcaactgtggcaatatacacctctaaatctgtggcagacacttttggtttacagcatgatgcatcctgatggatgcattctgaagtcagattgagctgcatctaaactctgctttaccaacacctgtgcaatctcagccaagagctcgaaactctcagagcctccagttccttcgtcattgaagtgagtacagagtacccactcataggttccttgtgaagagtaaatgagataatgttcacaaaatacttagcatgctactggcttataatatccattcaattaaaattgatgatgatgattcaggctttaatcatttcttgcactgatggctttcttgtcagtttttctttcaggaacatgcaattcttcctactctggttttgtttctccgcatgtctacagagctgccagagggttacatttaaagtacatgactgttcatgccaatctcctactgtccttcaatggctccccaaggctttctttctaaagtaaaaactcctttcattagcacgcaagtcccttcacggattgagtaccctctgttcctctaacctcatctctaacgctctcaagacttgccatttctgcaacagacagatccaactgctttgagcacttccaatgagtcatgcagatcatgtgtctgtacatcccacccagatatacgaggcactagccactgttccaatttatcaagcaaatgcttactcacactttagggaaacttctttaataatttagaatcacctgtatcttttctcccccagcatatacatactcccccagtgtatgtatatttgttgcaaagcttattacattttggtgtggatgtgatttacttgtttatttctttccaagtaatcaaaccaattcatctttccatctcacaatgttagacaccgtgcttggcacatacagatatataatggatatatattaactaagcagatacatatgttaaaatgagatctgagtcatgaagataatgagcttctctttcccagctcactgcagtactcttcttactgtgcctgactctgatgggctccattttagaattttaaggttgtgaggttgtgttaccagaaaggggtcatgatccagaccccacaagagggtccttggatctctcccacgaaagaatcagggtgagtccccagtgcaaagtaaaagcaagtttattaagaaagtagtgaaagtacagctactccatagactgagtagggcgtttccaaaagtaagaggaggaacatgtccaccctaggtacaatgcttgtatacacggggagatgtgctctgccacaagggtttgtgataaaggattaattttcttaattactgtattttgcaagaatcaatattattatctttaaagcaaaattaggagtgcctttgttctccagatatcgggatatctggacacccccaggtcaggtttgtttaatcaacattattaatctgttcccttaactgtaaacatctagaggcgagaaatgtgtgactttctgggaatgcggcccggcaagtcccagcatcattttcctgcccctcactcaagatggagtcattctggtttcaacacctctgacagttgacagggcattataggtaaagtagtagatctctcatcagaaacaagaatccccactacaaccaggccccaactcaccttatttcagaaatgagtgaaaaagaaaacatcttcaaagaggttatctgtgctcctgtcccttacgagcaagataaaatccactgtacttcacttagtactataatgttaagtgtctgcttcaaggtgaaagatttaactgctattttttacacgtggcactgataaaactcaaaatgggacacaaggcagaatagcatgacaatgacatcagatttagggaggcccaagtacgtctgtctttacaggattatttcttagaagttaactgggctcagagagagtatattcaaggtcttttttttccttttctttttaattagtgtgggtcagaggaattttgggagtggatcaatagattgccaacctcccactacatcaatgtaccttccaagggaaaatagacaatttagttaagctctgcatttcctgaacaacttctggatcaagagttcattatctgctatatttgccaatatgtaaagccttcaggatagttgccataattaaacaaacaaaaccttgtatttgcagacatatgatttgagattcaaaaggatttcttcttttatttttggtgttagctttgacccttattctgcttgtcactttttctttagggagtgtgcaattctaaatgcttctcgcttagacagtagctttgacatccagtacaagtggacccctcaccttttacaaaacagttaagctacttatcagatttcctggtttctcaaaccactcttttctatcaggtggaaaggactattctcttgggagatcgagggccatgagatataattaactttccccatcccttccctcttaggaaatggcttttaaacaacttctatgcatcccaccatggtttatgactacactatattaaacatgatgaagcattttcagagaggagggccatcattatgaagtgagtttaaaaacaaattcccatgagatctgataattatctcatggagcagagattatctgcctactgtaagaggctttattttgttcactgctgtgctcataataatagcttgcagtgtgatataaaaaggagagagtgaagcatacaatctcaggagaccagagacaccacttcagttctataaaggaaatcagacataagaagacaaaaacagtgcaaataacaatcatattctgaaaaagaatttgatcaactctcagtcatctttcttggttcacattgacgcagtttagcagaaacatttattgttcgtattattccatgtctctggctttcattcccacatgcagtctacaaatcaggtggagatatttaaaccaaagtacttcattcccttccccaaatgaggaagtagtgatgagaaaaaccgcagagaaagagagagcaagagcgcgagagaaggagagtaaagataagaaggctagcttactctgacacttgtcaccagcaggagatgtggtctagccattcctcacagagcaggaaaccaggggctgttgcattcagctgtgagcagaagacagagagggagcctgaaggtgggacttcattatattatttaaagcaaatttacaaaatctcctattcatgcgtaagttaaagtacagaatcacatttccaggccaagtataaatgcaatattgtacttagtaccaattcaaataaagacgaatggataattgagacctgtgagcaacacactccttggtaccaattcaaataaagacaaatggataattgaaacccgtgagcaacacactcacaggtgtcaggattggagtaccacagaaactgatcatcgctgcagccctacgagagcatttggttccatcctctcactctgcagatgaatataagccagagagatgaatcaccacactgagacccagactgggtggtctttctccaacgagttatgcaaagattatgtttatgttacatacaagtaagttgtgtgtgtgtgtgtgtgtgtgtgtgtgtgtgtctttttggccattttaagagtatagtatttccagggggctgttgtaagtattatgtgtctcaaaacatcaaaagagtgtagaatcctagtggatggaaataatataataatatttattgcacgcctgctaggtatgcaatgaggtatgttacctatattgtcacattaattctcaaacagccctatgagaaacacctcatcttccaggtgaggggtgctgacactctgagcagttaagtgcctcttgctatgttgacaaagaaatggagaatgagtttaaacctggtcactggtgtcccaaatcccagtctttctgcctcattagactgccttcggcacgtccactagcatggtctcaggaaattctgtttgtgaagttcctgcttgtgttttagcaagcgaacgagtcgttggaaataaataactgtcccgtgactcccactcatgacttttcttgacaacctgatggcagcattgcacaagatggaaaatgctgtgcgatgtctaaggagggtggagcaggctcagctgcaacatgaaacatccatcttcctttagcgtctcctctgcacatcattcacacttacagtgcagcccaacttttctcaagaaaagccatcatgtcccgtgaggctttctgggctctgatcctaaaaggacagtacatttggaagctgcctttgaagcctgttcacacatgtctgctgctgaagttaagtttccagtatgtgaggactctcagcataggggttggataaagtagttgatgaggattcacgtgtaaataatgaaagaagcaagtcgatctttgttgctgttattctgagggagaaaatagatgggctggcctgccactcagaggctgcaaggaataatttatcaggtgatgttatgtttgaaacacaaaaataagagttaggaaatttgaaagttggtcagcattaattttctgctagcaaacaactagagatgttgtcaaaaatgccagctaaggcatttaatgagggggtgtaccatgaaaacaagtagcagacacaagctcattcattatctttgttccttacctgtgaatactgaacaatttgtctttctaaatcagttatgtttatattatgatcattcaacacagaaagaattatccaatctaaaatcacctaatttatctagatcagggtttggcaaatattttctgtaaaaacccagatagtatttctggccaaattagacaaatcctggcctatttttttttttttttttcgtaattgttggcagtagcatgtttaatatgagaaagtcttctttgtttatgttcaaggacaaggagaaagagaatttgggagagatgatttgagtaggccagactggaagcggcagtaggagattacagtacggctgcttccttgctgtgggggatttatctttgtactctttgcttgggagagatagttaatgagtcttaacatcggctcacgacacaggtgatttgccagaaaagagtcctcaagggcgaattaaggaacagcccagaacaacaggatcccaagttattctatcatggtaacttctgtctgttcaagaccacacagcctcatctctcaatagcacttttttccccaaaagaaatgctattttcaacatctgacttaatttcacactgagttcctttgtttttaatttttaatttaattattataggatgtgattattttgtattcaacggggcttactttgctttggatattattatactttatcttagcctttcatcaaataacagtatcctacggtgtaatcaggcatcaagagatagagaaagatcatgcatggttttagggtccaggcacttccacatgcaaagcatctaactatagtttctctctgaaccccaggtggctcatgtatgaaatgaggctgggtgcggtggctcatgcctgtaatcccagcactttgggaggctgaggtgggtggatcacctgaattcaggagttggagatcagccagccaacatggtgaaaccctatctttactaaaaatacaaaaaattggctgggcatggtggcaggtgcttgtaaatccagccactagggaagctgaggcaggagaatcacctgaacccgggaagtggaggttgcagtgagccaagatagtgccattgcactccagcctaggtgacaagagtaagactgtatcaaaaaaaaaaaagagagagagaaagaaagaaggaaagaaagagagagagggaaggaaggaaggaagaggaaggaaggaaggaaaggaaaggaaaggaaaggaataatttctcactcctaaggtcattgtgagaactggagatgacacaggcccagtgcttgtcataatgtctagcccatcctagatactcagtgctggctgttcgtagcctaatatagcaaagtgctgctttcaaagccatgtcactttgtttctctcgtttttttaagcagctgaatataatgtctattacgtgtgggagtctcctttttctctgaagtaaattatgtctaaacaatttatattatgaatcattgggatgggtgtttcactgtctagaactcatattttcctatgacttcccttttgactcattatacttagtgaactaagtttctagtaacagtccaggaggcaggggcctgtttcatgactgacagtggttttgtgctgcgaagagatcaaaaggcttgattttacattgtcataccttatttttcctggactttgcttatgctctgttgatggtgatagcacaaggattcctataagtttgtatataataatgtagttgtttgtagaatttggagcttagaataagtattttttttctttaaaacagaaaattgtaatagtttcccttaaagggctgtcctctcacacagttaaaattagctgtcttactaggtaaaactatattattttgtaatgattaaactagtatggccattcacctcatgtctctcaacagtttcttgtcaaatttgggagaaaaaaaaaagcgaccttataagattactgcattccaaatgctagagtgcattatgcctgggaccaaatgggacaggatatatgctcgcctctacttggctgtgtaaaatttgcttggaaaagagacattctgtcttttgaaagagagcatgactttcccttgcattgtgatctatgagctgtagctaagagcaccctcggcagtgcagaccctaaggcaaacctaccacatgtgtctctccttctcccaaggatgttttctacaggcaaaacccgaatagtagagtgagcataaaggctgtcttgagagagagagaggatccagaaatttttaaagaattgcttaattgacttgtttcatgctctttctattccccctccccctcccacacagaatagatagtgcatcatctccttttatctcttatcttgtttctgtggggtttttttttttaacgtcattcatgctgtaaatcacttttttgtttgtttgtactttgcttctttatttttaatttttccataagttattggagcacaggtggtatttggttatatgagcaagttctttagtggtgattggtgagacactggtgcactcatcacccaagcagtatgcactgcaccatatttgtaggcttttatccctcgccccctcccactctgccccccaagtccccaaagtccattgcatcattcttatgactttgtattctcagagcttagctcccacatatcagtgagaaccatacaatggtttggttttccatttctgaattacttcacttagaataatagtctctaatctcatccaggtcactgcaaatgctgttaattcatttctttttatggctgcatagtattccatcgtatacatataccacagtttctttatccacttgttgattgatgggcatttgggttggttccatgattttgcaattatgaattatgctgctgtaagcatgagtgtgcaagtatctttttcaaatagtgacttcttttcctctgagtagatatccagtagtgggattgttggatccaatggtagttctacttttagttctttaaggaatctccacactgttttccacagtggctgtactagtttacattcccatcagcagtgtagaagtgttccctgatcactgcatccacaccaacatctaccgttttttttgttttttgattatggccattcttgcaggagtaaggtggtatggcatggtggttttgatttgcatttccctgatcattagtgttgttgagcattttttcatgtttgctggtcatttgtatgtcttcttttgagaattgtctattcatttccttagcccactttttgatgagattgtttgtttttttttcttactgatttgcttgagtttgttgtagattctgggtattagtcctttgtcagatgtatagattgtgaagattttctcccactctgtgggttgtctgtttactctgctgacagttccttttgccttgtgaaagcgctttagtttaattaagtctcagctatttatctttgtttatattgcatttgcttttgggttcttggtcatgaaatccttgcctaagccaacgtctagaaggatttttccgatgtttgcttctagaattgttatagtttcaggtcttaggtttaagtccttaatccattttgagttgatttttgcataaggggggagatgaggatccagtttcattctcctacatgtggctagccaattatcccagcatcatttgttgaaaagggtgtcctttccccactttatgtttttgtttgctttgtcaaagatcagttgactgtaagtatttgggattatttctgggttctctattctgttccattggtctatgtgccggttccctccctgattagcttaataactaacctcctgaattctttttcaggtaaatcagggatttcttcttggtttggatccagtgctggtgaatcagtgtgattttgggggggtgttgaagagcctcattttgtcatattaccagggttggttttctggttccttctcatttgagtaggctctctgagagaaggtctagggctgaaggctgtcgttcacattctttcgtcccccaggttgttcccttgatgtagtactctcttccttttcctatggatgtggcttcctgagagccaaactgcagtgatcgttgtctctcttctgggtctagccacccagtgggtctacccggctccgggctggtactggggtttgtctgcaacgtcctgtgatgtgacctatgggtctctcagccatggataccagcgcctgttctggtggaggtggcaatgatgggggtgcaatggactccgtgagggttcttagctttggtggtttaatgctctatttttgtgctgtttggcctcctgccgggagggggcgctttccagagagcatcagctgtggtagtgtggcgaggaaccggcggtgggcggggccctagaactccaagatgatatgccctttgtcttctgctaccagggtgggtagggaaggaccctcaggtgagggtggggtaggcacctctgagctcaggctctccttgggcggtccttgctgcggctgctgtgggggctgggggtgagattcccaggtcactggagttatgtacctaggaggattatgtctgcctctgctgagtcatgcaggttgtcagggaagtgggggaaagccggcagtcacagggctcacccagctcccacccaaaccaaagggccggtctcactcccaccgtgcaccccccaacagcccccagtccgtttccaggcggagagggatacaggcctgaaaacctgccccaggctacccgcctcccagctgcgagagaaaaaggcttggttcttcccccgcctgtggagtcagcaccccggattcgtgccctgccctagttctggccaggaggattctcacccagttcaaactgttacaacgctcagctagagatttccttctccctgtggagttttaccccctcctctcccgatggatccctgtggtgccagcaggaatgggctgctcggggacccagcgagctccgcgggcctttccgctgcttcctctacccctgtacctcactgggctccccagacggactcagctccaggtaaagttggaaattctcccgcaagcagaccttcagcttccccagtgggggtgtgtgtttgggagaggagggtctccctctcccacttctgcagttggggcactcacacttttgcgggggtctcccgggtcctgcaggagcagcccacttccttcagagggtctgcgggtcctctcgggactgctggtttcttcctgcagtccatctggagctaaaagtcacaatgcgagccccgcacgctgccctgtcgggagctgcaatgtagtcctgcctcccgtccgccatgatgatctgttctcctgctgtaaattcattccagatccagattctttctcagcggcccttggtgtgtgtcagaagccataatcggtgtgtgctacccacccctactatgcagggcagcttcatttccatgggttgcattgataattattggcttattattatatttttctatgtcactttacatttcttagtgtttcttacatgcttagcatatttctacacatttttttctaattcccaaatgagaagaaagcaaataccaacagtattttctttctttgatcgtatatccctctgttcctgtgtcaggaaaatgtgaagattcaaaagataattgaaagatgattttaaaaagtatttaacatttattttaaaagcactaaagtttgttagcaaaaggcttctgttaaatgttgggagaaaagaaagacttttggaatttcatggaaatattattcatgtgtatttaccaattggttatatgagacatgaagttttttcctaagagataaattctgatcttatacaaacctgagaatctatagggtaagaggtggagaggagagacgaacatcacatacacatctagcaataatataataatataaattagtaaaacattcttgagtacagttagcaatctgtattgaaagccttaaaatacaaatgtaaaggtgggcgatagacaccttctctttagtaatcagaaaaattaaggcaaagttgccatcagttgagatacccagtaattttttacttgcatgttcctcctggctttgtatataattattgcaaatatagcttatagcctaattcctttcctttatgttttaaaactcctagtgtttctttcatgctgcagtgccttccttcagttcaactaatgttcacagaaaatctgtagaatgagcaggtaaatcctggaacctcagaatgtcaggaagtagagcagagaaggaggggtacgggcaggtgcgcagctcggcctctctcagtgctcgggtgtgtggtacaggtgagtgaacacctgggcttgcttgtgcccatagacacattaaataccagacaattaaagtaggacaaaatcaacactttcctggaacaccgggggcaagatcaatcccaggcaaacagctgccttcgtggctgcccttttgatattctactttctcaaattattcttacattctttcatttattcatcaaatatgttttgctccctacaacatgccatgtactttgctaagattagggtatatagataaataagccatgactgcttctagcacaagaatatgtataaagaaagttgtagatctatatagaagaatagaagcaaaggggcagagtggcacagtgaccaagtgcggacttgcaggtgagttagagtttcagaactcctttgtgtcatttatgtgacttgggtaacttatttaacttccatgagcttcagtttcattatcgtaaaaggggataaaatgcctatgttaggaagttatagtggaaatgaagtcaaaggaaagagtgtggtaaaacagcgagcatgtatttgggacacgatagcagccaaaatattgcttaagcattacacatatgtaacgtatctcctgcttacctagttggttttctttttttttttttttgagacggagtcttgctctgtcaccaggctggagtgcggtggtgcgatcttggctcactgcaagctccgcctcccgggttcaagcgacttttctgcctcagcctccgagtagctgtgactacaggcgcgcgccaccacgcctggctaatttttgtatttttagtagagatgggatttcaccatgttggccaggatcatctcaatctcttgaccttgtcatccacccacctcggcctcccaaagtgctgggactacagacatgagccaccgtgccccgccgctgctcaccctgtttgacgaaaagtttcaagtggctcaggtcctgggtggtcggcggggacagatggggagaggtctaccctcattcctgggccactacacaagctgtaaatgttctgtaagctctgccgcctcacctttggacgagtcattctttctccgcagtgtgcagacacacctgcaggttttggggagcagaaaaatctcattccacaagtcttaacacaaatccttttccctgtcacttaggccagcttctcagagtctctgtcttagctttgcagcggctgccatgctcaggaatgtgatctctagagtatcaggtgtgaacagatgtgggaaatataccaagaacacataaatcaaagttgcatgatacaaccacagaggtgatagaacagaggagtccccaaatccacccccatgaggtcaagaaaaatttctcagagaaagcatcctttgaaatgggctattgtaagaaaataaggaattgcatgggtgggacagatatgggagggtattccaggcagatgaaataaattatgaagtactgaatcccaaattatatatttgtgtataccccgtttgttccctgctagtgagtgcaaataagggcattttaatgccccatcaccatggctcttactagccaaactgaagggcattagccagccctgtcttcaaacatgctccatccactgttctctatcccagaacctgtaggaaaatatcagagatgttgagagagaagcccactcatgttctggtgctccactttccccatggaaagctgctcactggtaagtggcgtgacccatgaaggtcagtgtcaatgccagggggagacagtatatcctgctggatggagatgccggggggagacagtatctcctgctggatggagggcgtgcagttcctccatcacagcttgacactcccaaaaaatagcgacaactttgttcaagtgcaaaaagaacaatcggatttgtattggagaaactttactctggctgctggatggggaccggatttagggagaaccatcaggagcctgtcctcattattcaggtacaaaatgatcatggcatgagttggcagtggcagttgtgatgaaaggaagtggataaacttaagagatatttagaaggagaatcaatagcacttcgtgatcacctggagaccccgagcaacaacagggcaaagtcatgagtaatttagcagattctggattggaaatgggatgcagagtgctgctgggccctccgtgaggctgggagagctgagtgtgtgtgtgtgtgtgtgtgtgtgtgtgtgtgtgtgtgtgtgtgtgtagagctgggtaagtatttgggacagggaagctgggacaataacaaggttgaaactcaacttagagttggaggtgcctgtgggatattcaagcagagggtttccaccaaatgtcacaagcttgtcctatttcttttcttttttttttttatacttgaagttttagggtacatgtgctgaacgtgcaggtttgttacatatgtgtacatgtgccacgttggtgtgctgcaaccattaacttgtcatttagcattaggtatatctcctaatcctatccctcccccctgcccccaccccacgacagtccctggtgtgtgatgttccccttcctgtgtccatgtgttctcattgttcaattcccacctgtgagtgagaacatgcggtgtttggatttttgtccttgtgatagtttgctgagaatgacggtttccagcttcatctatgtccctacaaaggacatgaactcatcattttttatggctgcatagtattccatggtgtatatgtgccaccttttcttaatccagtctatcattgtggacatttgggttggttccaagtctttgctattgtgaatagtgccgcagtaaacatacgtgtgcatgtgtctttatagcagcatgatttataatcctttgggtatataccctatttcttctttgtgcatttccatgggactagaatgagcccctgccctccgtgagccaacgccaactctttgtccacatcctccacaccatccttcccagtggccccaggccacactgagcccctagcaccggaatgcctggagtcccactgtctgtgcagttcacgagctgctcagaagatgctgcctcccctagtaaatcacagcctcccctaaccgagaagagggctgcaaacagtgggaagttaaatatatatatatattttgtttaggttgttggaaaaagccaggaaatgcaaaggttctaaatgatgagaaaccagatgagatgagggtgatctttctttctgaaggacaggagaaattgactctgtgttcacaacatgaacagctaaccattagggaatgctggttgtaagttcggcattgctctacacactttacataccttattactatattcatcacaataaccctatgaagtagaaactattgttatcgttatttctacagatgataaaactgaagctcagagagtttaagtcactttccccaaagtcacacagctaggaagtgctaatcaagtcaggaagtctacatttttgagacagagtctggctctgtcacctgggctgagtgcaatggcacgatcttggctcactgcagcctttgcctctcgggttcaagtgattctcctgcctcagcctcccaaggagctgggattagaggcatgcaccaccatgcccagctaatttttgtatttttagtaaagacggtgttttgccatgttggccaggctggtcttgaactcctgacttcaagcaatccgcccgccttggcctcccaaagttctgggattacagacatgagtcactgcacccagccaggaagccccttctaaatcagaattctaacttggtagtttaggctctgaaccattcaaagaatcttaatttttaaaggaataaacacatataaaggaagactcattcttaaagaagggagttgcctttagaggtgtaagtattttgagtctttgtacatatacgctttctgtgtactctgttcccaaaagaagtaaaagttctaccacctaaaatttttttattggaatttacatctttattgctaggtaaacataagttacaactgaacgacttagtctcctttgatcatattttagtgtcagataccattttttttttgtttttcctaagtaaataattgtcttgtttgtttgcctagttttccatgtaactattagtaactcatcttcaagcttcttttttttattttattttatttttgaggcaggatctcactctgtcacctaagctggagtgcagtggtacagtcatggctcacggcagcctacggccttgaccttccccaggctcaagccatcctcctgcctcagcctctccagtagctgggactacagggcatgcaccaccacacccggctaaattttgtatttttggagagatggtgtttcaccatgttggccaggttggtctcgagctcctgagctcaagcaatccaccctccttggcttcccaaagtgctgagattacaggtgcaagtcgccacacctcaccaatatcctcaaattttctgataaaaaatatgatactcttctcagcctgtctaccacctaacatttagcataaatttattttttaaaagtagccccaatttattaaatacatgctctgtactaggcatagtgctaagtagcttccactatttgtaattttcacaggagttctattcgctaattatgagtcccatattccacctagacacattgagttttgaaggagttaagccatttccacttagcaagtggaagggtagaatgggactcgaatctgtgactgaccaatctcagaatccaaactactttctctaccccttcttaaaacaaaccttggcaactcagggcttacgaaattggcaagtccttgagaacacaactagtgaccatggtaaactacggaagctcttcaagctgcgttcaggctgcacactggaatcccatctgagtttcagaggagggggaagcttcctttctccaagagttgtcaggagtaactcactgttctgggcaatggtggccacagtgctaaatacagacggtaaactacactccttctggaaagaataaaatccagcacatacacgtgaaagatgatagctgctgtgtgggagaatggagtgaacacatgagttttaatattctgaatgtgtaaaaaaggcaatttcttattataagggcgttctgtatattctgtcagcatagaagagacaaaagggactaaaacttttaaaattgaatgtcatctacatttttagcttggatggatggtagaaaattgcttcatgaatcatgtggaatagatggaaagggaaagtggaaaaaatggaacaagtcccagctgtgaaacaaaaggattttgagtccatttcctgagttcagtaaaaagctgtgtgatatttggaggagtctcctaacttcttagcacttcaacttacttgaccataaattatagattataatacctactttataagacaaacaaacaaatacatgcgtgcaaggctaatgtggaaatgcattcactccacaattactgttcttaactcctacttttcatagtgctatacctctaaaatggttttatatgcattatttcatctaaccacacaatactataagacgtttaaagatgtggtgctagaatataaaattcccaattttaacatttgaaaacaggaactataattttaaagcatgtattataagaataatatttctttaagactattcttactattttatatttaaacacattcttttactgttaacttcaaattcactgcattgtattgtgaaagaagaattttaatgatctttctgactgtcagaagttctcttgctcattcttcataggaaataggtgctgttacgttcttgtttattttttctacacatagttatcttattgtgaaaggctgttttgcaagaaataggaaatctgcttaccacaaattctgataattagatggtgaaatgagacccacctaagatgattaaagagttagaaaatatggcctaagtagaagcattaacacagttacgctgtataatttttaatcctttttttaaagaatgggttgatttaacaacaaactgtttcaggtagctgccaataatatttctatctatcttaatttttttttttttttaagtcagagtctcagtctgtcacccaggctggagtacagtggcgctattttggcttgcagcaacttctgcctcctgggttcaagcgactctcttgcctcagcctcctgagtagctgggattacaggcgcgtgccaccatgcctggctgatttttatatttttagtaaagacagggtttcaccatgttggtcaggctggtcttgacctcctgacctcgtgatccacccgcctcagcctcctaaagtgctgggattacaggcgtgagccactgtgctcagcccttcatttcttatagatcaagaaaaactgagtttttattgctgcatgagatcaatagtttaggaataaagggtaatttttgataggatttatgtagtggcaacatgactaagctgaaagagctaggaattggaagacctgtatgaatgacctagctcttctgcttaattggtggcttgatcttggccacgttttcagatgagcctcccttgcttgtttgtaatgggaagaagctgtgcgtgcctcccacctcacctgttgtgaaggtccaaataagaaaatgcataaaaagcactttgtaaactgtaagggccaaacagataaagctgtttttgaatgagggaattggagacagaaatctttttttgctaaaagtcttcaaaagtaagtcagaatctcatttttctgggggtagttctagccagtcttttccacaagtagcaagaaagactaggggagcactgtcaacatttgtcatgagggggtcgggggttttgttctgcttgcatatatagctgaaaacttcaagactctttatgaactgacttgacaagatactccatcaccagccgtgattatctggtataaaagccttatggggatgttgctctttgtcctgaactctctctctcttttttccgactcctgtgtctggcgagtacatactcccttctttgtactatgctggaacaccttgctgtgctgcagtcatcattgttgaatccgacgtggcttccctcattcgtgcaataggaaattcactaattaatgactgtatgccagctgtgcctcccagccgctcttcaccctgccctgttgtacttgcacatccccattccttccctcccactgcctatctccacagcggaagctggacaccctggaacacctacattctaaaactgattttaagtctaacaggatgagaatgtcctactaggctacctgagaacttgatctataaactgtaccggtcacatacccccactctttcagaaattgcttgtattttattgtaaaaattattgttacagggttaagtgctgctaggaaagtcatgccgcaaggagagcaaacagccctcgtgtcctgggcatgtcctgatttcttccgcttcaatcggtgccactattctttttatcaagacctgaaattattctataatttccttccagcaccaaagatgctatattttgaaatatttttatctattaaattgcttttcattcagtaatatttttgtctttattaatcagatctatcaatcaaaattcatgatcagggtgagacaactatttgttaccacacatggctgataaactcgcagccagaagcaaacgattttgcggtttttcttagcctgggctgctttaaggagtgtaaatttatgaatctcaatttcactgtttggaagtatctataagagctctgttatggacggcagattttggttcccccatcctgcccctcttccacatgtcaaagacctgaccctccagtgagatggtgtttggagctagggcccttggggggtaattaagtttagatgagatcatgagggtggacctctcgtgatgggattagtggccttctaaaaataggaagagagagagatctctctccaaacacacgcatcaaggaaaagccacgtaagaacatagcagcaagaaggcagcattctgcaaattaggaagagggcccataccacaacccaacagtgctggcagcctgatctcagccctccagactgcagaactgtgagaaataagtatctgttctttaggccacccagtctatggtattttgttatagcagccctggctcattaagaggagcgctctcaatcctcttgctatctccttgcacccttaggattgagaactttttttttttctttgacggagtctcgcgctgtcgcccaggccggagtgcagtggcgcgatcttgcctcactgcaacctctgcctcccaggttcatgccattctcctgcctcagcctcccaattagctgggactacaggcacccgccaccatgctcggctaattgtttgtatttttagtagaggcggggtttcaccatgttagccaggatggtctcgatctcctgacctcgtgatcctcccacctcagccgcccaaagtgctgggattacaggcgtgagccaccgcacccggccaggattgagaacttccaacatgggaaccactacaacagaacaagacccttgaaacaggtttgtgattgtaattccttaatgctgaccatgatgtgtaaattacaatatgtggctttcattaattcaacattagtttgagccattctattcgattatattatcagtcaccatatattagttattctgtgggctcaggaaaatatgctaagtattttatttgtgtgggaaatatgttttttaagaccaagtatttgtaaatgttctcttttctgtaggattttttttcttttggatacaaatatagttaaagctcattgagaacctgcctgatggatgcttctatgccttgtttctaacagttccccaacactttaagaaactgaatattaaagaagatatttgtccagggccactcaactggctggtggtagagctgagatctgccttctaggttttatgcctccaaagctcctgaacttcaaagtagatttcacagtcactttagcaaatggtctgacccacattcttcccaaaattagatttactgctcaagtcaattggagtctttaaaaagttacttattttcatggcctagactcagacaaatgcattcctagtgaaactgaaggcctgggtcactgaggtattggcctttcagtcagcccaccatcgtggccaccacctaaggtggatgagttgtcatgcaaggagaatgaggagggtgggaagggttcttatgcttacccatgaagaactggggagattctgtctggagaggagagaaaagaacccatgcctttcagcaggaagagatatcttgtcatctgatatttaagtaacatttcatggccgggcaccatggctcaagcctttaatcccagcactttggggggccgaggtgggcagatcacgaggtcaagagatcgagaccagcctggccaatgtggtgaaaccccgtctctactaaaaatataaaaattagctgggcgtggtggcgcgcacttgtaatcccagctactcgggaggctgaggcaggagaatcgcttgaacccaggaggcagaggttgcagtgagccaagatcaggccactgcactccagcctggcaacagagcaagaccccatctaaaaaaaaaaaaaaaaagtaacatttcattaaggttcagcagtgattttactaaccataccctttaaccacacacacacacacacacacacacacacacacaccacacacacatgtaaaagagacttctggctctgccactttctagctgtctgacgtctgtttcagttttcccatctgtaaattggggcttaataattgtacctaatttttagagttcttatagagattagatatcttcatacagataagtcccttagaaagattcctgacacaataatgttggatattatgacagtaattattattttcagactgtatgctctgatgcctataaataaatatgccaatagaaatacatcctcctgacttttatttgacttggcccatgctgcaatatataatgtccatttactgctccattccctttgtaatcaccacttcccaaaataatgattccttctcatttgaggcgtcttgcagaaaacactggaatgagatttgaaatcacaatcaacacatccccaaagacataggttaaaaacttattgatccaatccagtgaacaaaatagagactactcaaatcaaagatggtgcaaagataaatgtgaaggtcatattaacacaaggaaatgttgccaaggtaggaaataaatatcaaccaaaaaatgacaacagcctggaaaaatgcaaactagaaaatctggagggaaggaagtgctgaaatataaaccaggaatatgcttcaaaaaagtctggtataaaatacaaaataagcttgaaataaagcaaaaaatgtatgatcttaagaactacagttaaggagacgtgaatgccttatcttataagcttcttaaaggcattgaatttgcttggtctttaacagatatataaatgtcatataatatcatacttgtttttaactatctggttgaggtatgacagtaggaataagtgttagaatcattaatctgtttttaattctgttttcaaatcttgtgcatgagtgtgcaggttagtgagcagctgggtactggtgtactgaccctaccactttttcctacacattttcatccagttaagcaatagtgggggaatctagcagaattcaaatcatcagctttatgacttgtaaattgaattagagcattcgattttggtctgcagactgcccactccccttttaaattagattcactctcctagtcccaggcacaactgtccatgtactgtctttgcagatggcttccatttcttgggctaagactattgctctaatcctggagtataagaaacatagtaaaacatgtcaatataggaaaacatagtaagcagatcatggatcttggaagtcagacagaccagaattcatatctggctttgctacttatcagttttatcatcctgaggaagttatttaaattcttcagacatcctattactcttctctagtatgcttgctccagatggaaatgtcagaatccaaaatccacaatgtaagcatataaattttttatttaactagatcaatttctgatgttaaacttttgtttggagaatgcatcttcactttgaactggaggcaaactattcactggaatagtctctttcctccaaattacttttcagagaacttttgttcttcctctcctccttccttcctttctttccttccttctttttctttctttatcccttccttttttcccttcttactctctttctttctttccttcctccctccctctctctttccttcctccctccctctctccttccttcctttcttcctttggaaaaaaaaaaaaagaaagaaaattcttgttttacaatactggtagaacacaggcttcgtcaggttgagggcttctacccaccatgcagtggtgttacagaccgtttctacatcttaaagttgtcaagggtgtcggggtggagaggagggacgcttgcctgagtcctcagtatccatgttatgggtgagtcaggtgttgactcatctcacacggccccatcctggtccacggctttggcagattctctgctacaatggggacaagatctttttgaaattgcccctacttccctctgccagctgctctttgaatccacactcacctggaggctcacagcctccaggaagcaatgccagaaatctggggctgggtttcccctgatgcaggacctcaaaatatatattcttcttttctgttccccttcaaccattgaagacattttttttttctaatttgtggtggggaaacagctcctttctcctatttgcagctccaagatgatactcctttggtgagctaattctcttgtacatttcttctgcttcgtctgaaaagtctttgatttcttcaaagaacttagacttttcttcctgctccctcctaagacattgtggtatcttcttgactgaaagaaacagacaggttaaaatgtgtgcatgggggtaggggttggaggaggagaacaaaacaaagcaaaacttacacacacaagttaatatctgagtacagcacccagttatagcacctgcgtgctattgattggagataaatgtgccctgtctataggacattagtaacataaggtatattctattagaaataatgcatgtaagtgatggatcatttttgttgaataatgtgaaaatcattacagtgaaaagagaagacttcagacctacaactgtgtttgtgtatgtgtatccctcgtgtctgtatatatatttagaatacttaaaacacattcaatttactaatggtttactgcttcccatgccctgtttgctgtacagctagtattgtgctaaatataatggtagatatgaagtaagcttcacacatgtaaaattctttcggagttatatggaacgactaggaaattatttgtcagagcagctttgacttcactctttaaaaaagtctctctgaaaagttgacacttttgtcaaaaagattcccacataatatgacaacataagagtaaacttgcactgatacagagtcaaaaataagaagtccttctacatgacttcaagctcccagtcagatttccttgtagatgactgactactccagaagaactttaaagaattctggcatgcccagtaatgaaggggacccgtccagcactgaaggaacaagaggatttctaaaaagggacacttttctaatgcgattcactgatctatttagaaaccatggcacaaatgaaaacatcaagtgtttgtgttagaaaactgatgaaccctgatgaacacaaataagtgatgttttcatgttttttttttttgctaagaaaaaagattatagaaaaatagcaggcaacccttatttgccaattagacacaaaatgaaatcaaaacccaacatttatagaaagaacaattaagaaacttttggccaactacaagttcaaagaaaataacaatagtaggcgacaaagtagaaataagtcgttttgctctgaaaggttatagttgaaagaaggtgactatctagcctagagatttcgtagaaattgtggcatagtaaactcacctaaaaagtgttacagtatttcaaattagctgctcacaaaagcgaaagccaagtctcatttttataaactccagtccttctgtccaagttcttttgtgttaactggattctacagtctttttttaaaagaaaacaacaacaacaacaaaacaaaaaaaacacttaatggattaaggttgcatcttgggatttagtcattttaatatgtggaacttctctcataattcttgatgaatgttctttcaaattttacctgcgtcatatttcacaaatattgattgcagacagcaaatgttgctcacttcttcaccaattgttttctcagactcaatcctcgttttagttgccactgacagactttgtactcacccaagaacattttagaggagacctagagcttttagttggacattttcttggaagcatctatctcttatgtaattcaagccttgcttgaaactaaatgtggagaaaacaaattacaaaaattcagaaagcattataattacaatgctgggggcattttattcccattaggaggaccatggatctctccttcctaactataacacctgcagatcatttctctgtgtggacttaccagagtccagtttctaacccgtagggtggagaataaggtacttcattacaaacctcaaatgcagtgtcaacatgctgagaccatttccctgagcacttgttccctacagcatgagagaaaatgaccctttaatgtgtattcagtcaaaaaaaatatatttgtattaggaatatttctctgagacttctgtgctgggaattaaagctatatctatatacgtaaaataaacaaactgccccgtggctggtctgctcatttcagctgtcttcatgatcaatgtggattgttgcacaatcgattcaaccacagcaatcagtattattcatgcactctaggaaacttggtgcaagtaaaatggctgggatgttggaaagtgtactcacttgttagatatttgatttaaggaattttgaaaaaatcgcattttatttttttaaactctcaatttaatcttttctgagtcaaaatgttggatccctagaataaaacctgaagtttgagataatcttttcaacatctcattaatgataatttctgtaaaatcttaataatttatcgtgagtcttctagtgctaaatatacacttaaaactcagagaaaaattgccatcataatttccaggacagtaaagcttgaatgtctagaaaaacagtgtgtggttcacagaaacttagattaaagtccagttggttaaaaaaaatactctttgcaaaattttctctagcatgtatcatacgcaaaaatgcccaatttggcagcttttctaggtagctttccaatcatcagtccggcagcaacctacaaggatttaataattcttatatctaggcttttcaaagactctttgtaagaaattttgattttttctatattgtaaatatcaaagagattaacttcccaagaagtcactttgtttagtaaaagccaactacaaacaagaggccgcaaatcaaagtatgttgtacagacatcattattggccacatagtgaaattctacaatatcaaatgccccaaagtaaattggattccaggtgaatttctgtgataatattgaatgcatctgccattgaaaagagacatctgtaggtcttcaggtgaaattgtttactaacttaggtcaatataatttgactaccaattgacaaaattgttctattggatatataaaggctatcctccaggaaagttaaatatctgctaaaattgcgaagattctgatatccaaaaataccatgaataccatgtgagaagcagagtctactatgaagaccacagaatatctgtgttgtcagttcatttcgactagaaatcagttgtattcctcgtggaatataaggaatatattccttcaaggcagcagatgttaaacttcttggtctcaggataccttttcactttaaaaaatattgagggcttcaggagtttatatatatgttgactatctctgtcaatatatagcatattaaaatttaaactgagaaattttttaaacacaagaatacacaggcacacgttccattggctgtcagagtgatcgcatagtcactcttcgtgaaacctctggagaacactgcgtgcccacgggagaatgagagcaacaatggcaaacaacgtctccttattaaaatgctttgacctcaccaaggccttgaaacagtattggggacccctaaacacgtctcagggacctgtttcacacatcatgagaaatgctgttccaaagactttttctcacttgtagaagctggataataataatcacaaagatttgtttgttacatatatgttgtgtaaatataaatgatcattactgagcaaacttcctaacctctccaagcatgagttccatcagctgttaaatggatataacaataccagtcttgagggatagcattaggagatatacttaatgttaaatgacgagttaatgggtgcagcacaccaacatggcacatgtatatatatgtaacaaacctgcacattgtgcacatgtaccctaaaacttaaagtataataaaaaaataataataatagtacctccaaaaaaaaaaaaaaaaaccagtcttgcacggtggttgtgaaaattagcattgatgtgtgtctaacccaaagtaggcacttacacattacaaaatttatctaatttgtttaacttctttctaactattaattaattatgaagcaaagctatgaaaaatgtataatctaggaaaggtttttcttcttatgcaataatgaccaaatgaagggaacacgtcaagaactatcctctggctattgttattctgatgcaaaatgtgctgctgaatgtttcttactagatacttacagaagcatgaagaacatttgtcaaacttagtcctgaaaaggtatggaatttgtggggcataattaaacatgaatataacatttcacacaaagtgataacactggaatgaaaaaagaactggggcttcatggagcatggagcatttgtggtgtatttgaagggagaggaggtatttgacgataagacactggtaggagttgagtgaagcacatttttttattattattattattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgtggtgtttggttttttgtccttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtatttgctattgtgaatagtgccgcaataaacatacatgtgcatgtgtctttatggcagcatgatttatagtcctttggaagcacattttaagagaaagaaatcttcaaagcttgactgttggtcacaagtcaaggttggaggcacctccaagccctccaaatactagataaggatgagctgacagcaataggattgcatagaagttgtgttaggctcccaagtactctccctgattccatgcagtcatgggaaattgcttctcctcatcctggcagaagcaaggtttgctttctgcagacactcattcagagaagctgtgtgtaggtgtaaggcactgccccaggggagtgtcaggtgctgctgaacacagagggatgaaactggtgtctccatcctgaagagtgacagccctgtcccttgcacttgaaccctgaacactggcaccctagataatatcattcagggaaaagaataactcaaaaggaatgaaatttggatattgattttgggaatctaccaagaaaatgactggctccttaatcagtgtatagtgaggcccatcagtcaacaagctcacccaggtacagggagtttctgagaagttgtctgcatcttgttcttaaattttactagtgacctaagaaataaggattactatacatttgagaatagcttgtcatatgtaagatagggagcaaacctccccatactctgatagccagctgggtagctagctagaagactgatgataggtaggtaggtaggtaggtaggtagatagacagatacatacatacatacagatagatacatacataagtagatacatagattagatgataggtagatacatacatacagatagatatatacatacataaaaagatacatagattagatgatagaagatagatagatagatagatagatagatagatagatagatagatagacagatagaccgaccaatagataaaagagctctgaagtcagactgcttgggttgaaacattgtccctgccccctttgctaatcgaatgaccttgaataagtcacttaaatcctgaagcctcaattttccttatctgtgacatgaggataataatagttcctacctaataaaggtgaagattacatgaaataaagtatgacgtgcagactaagcatctaatacatattttcaacataattggcaaaaagtgcagggtatgcttgaaaaactccgtttttcggcttagttgaattactctgaacataaagtagaaagcgaagatagagccagatggtattttattttgactattacatactaatataacttaggctatgtgagagaattatttacagggaaaagtttactaaccttttcttcacctaagaaagttcccacgaggcactgcctcacaccttctgcccccaacaagaaacagtgcgtgactcttgagtacacagggtgtgaaaagctcataataccctaatatgtctctctaagtacaattggttgttcatgttaaattggaaacacttaataactgcaaagttaatatgtgattaaataacaacagcaaaaaacctcttctccctcttgcccaaataggggctcatagctctttcagtgtacccggggcccctttctcagcttcagaaggctggatattgtggcaattaattgtttaaacacactacgaaggattatgatgagaggaaaacataaaacataataaacacttggtaaccagtttatttcaatagcagctcctctgccaagccagcagatttttctaggacagagctcccttccataggcagctaatctaggacagagctcccttccataggcagctaatctaggacagagctcccttccataggcagctaatctaggaagagctcccttccataggcagctaatctaggacagagctcccttccataggcagctaatctaggaagagctcccttccatacacagctaagaaagatcaggggaatggccttcaatggaccccgctcatcattccctacacagtcgcaaaaggctcaccacctccttcccatggcccggctaaaagaaaaggtgttatgtttctttaactctttggagcataaaggagctgttttttttttttagtaagaataacattataatcaggtgttgtttaaaaatagcaacaaggcacaaagaaaacaggcattgacaccaagaaaaattagctgacaccacgtaataggagagatttattcatgaatgacggaaagttatagaacttcttttctttccttagcagcatgtcatcattgcaacaaagtcatggcaagagcacgtgcaacattaggttcaattgatctcagatccttcctcaccagtgtcgcagcaaattcattcttcaccaatagcttaagtctttctaggttcctagactcctatgtctcaggtggggttttttaatttatttttgtttttgttttaccccccaacattaatgttcctgagaggtgtgtttgttttgttttgttttgttttgttttgtttgagatagagtctcgctctgttgcccaggctggagtgcggtggcgcgatctcggctcactgcaagctctgcctcccgggttcacgccattctcctgcctcagcctcccgagtagctgggactacaggctcccgccaccacgcccggctaattttttgtatttttagtagagacagggtttcaccatgttagccaggatggtctcgatctcctgaccttgtgatccacccgcctcggccttccaaagtgctgggattacaggcgtgagccaccgcgcccggccgagaggtggttttttaattggtgagagggctggggggatcaggcaggggaggttgcagtggcattggagaagacaatgcctaggggttgattagttaccactactaagggcctacagattcatttgggaaaaattctatggaaaatcaactggaggaaggtttcttccttggggagggtaatgcagggtgcccatgtggacatgcatgtgagcatgtgcgtgctgtgtgtaggctccaattacccttcaaatgctaatcttctatgattttacacattgataccatgaccaaaacatgttaattacacatgtgcacagatcactggaaaatgtatatcgctgaagacttagtttcttccatgtctagagctcagtttattaatatgttgttccatataacaagttcattaatgttgctgatttttaacatttagaatattaatagttctgagcatgatattttgatctttcctcagagtgatttttgaaaatatgaaaaatgagaagagaagtagttacctattaacttgctgaagtctgacaggaacagttgaccagagtcccctgcaagggctcttgggagcactgggtaccgagcagagccttcatccttgttaattaaccgtccaacattgagacaggacttctgcttagaataaatggcttgttagaaaacagagctacacacatacacagaatcttttcattcacggataactgagtgttttagaaaatccagacttttctaagactttccaagttttaatttcaaatatattttccatgtttacattataactgaccatgtgtctaaatatagctagtctatactatatgtattctaattgcttgatatggagcctgcagctgagtacttgaatccagcattcacagagtgatacagtgtatgaaaaccttttacaatattttcaaacaaatgtaatgaataataatgatttaaaggtcataactcttagctattcttatattttatgacattcctctgcaaggcaatatgcattaaacaatggctaaacattaaaaatatgttttagaagattttaaaaataagaggcatttcagatctgcagaaaatcctcatgtgtcatattattttaaagaaatgctggaatgcaaatatgaattgacctatacttgattatctgttttgatttcattattcaatgtcttcacatggaagatcttgacagtccaacaattcgttttctgttctcttttcagatttttttttaatttggaaaaagaaaatggcattttatttcctgcttttatggactccaaagtcataaaattgtaaagaggagaaaaactgtcaattttttaaaggttaaatgcaagaaaattagagtgcctagaagagcagactctggattcagtgctgaaaggtagatagcgctggaaggcaaactcaaggctgagtattgaacaaaaagattgagcaagggtaaatatgcagaagcagccccggtgaaccattccagtgatttcctttgcccatgtagttgcattgagttgcactgaatgtgtgcagcctttttactgcatagtagaagaatggcaattgtgtttttaagctgaccattaactttagagggaaagctgccgaaaggcaaaattttccttcccttctgccctcaatttttcctctcaaggtgtaggatggaagctttgtagttaagaaaaatctcagtaggcctgtcagaaaaactagattctaattgctgagtgtagcagagctagcacagtttttaatgtttgcacagtagaattagttaaagcaagctctgcagatacaggtttccatgtggggaacacatgatgttctgaccgacaagttgggtgtttttagttccagacattgcttgaaacaatagacaccatgggtgaaagaaagaaagggggacttatcactgcagaacctggcacgcatgaagaggatttcccccggcccagtgaaaacatgggcctatgaatattttcaagaaaagattttcacttaactctctctgtaaaacacagttgttggggtgtggtatggtttggctgtgtccccacccaaatctcatcttgaattgtagctcccataattcccatgtgtcctgggagggacccagtgggaggtaatcgaatcatgggggtgggcctttcctgtgctgttctcatgatggtggataagtctcatgagacctgatggttttataaagggcagttcccttgcacaagctctcttgcctgctgccagtaagacatgccttcgcgtctcctttgccttctgccatgtgtgaggcctccccagccatgtggagctgtgagtccattaaacctgtttcctttataaattacccagactcaggtatgtctttattagcagtgtgagaatggactaatacagaaaattcatactgggtagtggggtgctgctgtaaagatacccaaaaatgtggaagcaactttggaactgggtaacaggcagaggttggaacagtttggagggatcagaagacaggaagatgtgggaaagtttggaacttcctagagacttgttgaatggctttgaccaaaatgctgatagtgatatggacaataaagtcctgaggtggtctcatatggagatgaggaacttgttgggaactggagcaaaggcaactcttgttatgttttagcaaagagactggcagcattttctccctgccctatagatctgtggaactttgaacttagagatgattcacagaatctggcagaagaatttaagcagcaaagcattcaacaggtgatttggtgctggtaaaagcattcaattttatgtattcacgaagatatggtttagaattggaacttatgtttaaaagggaagcagagcataaaagtttgaaaaatttgcagcttaacaatgtgatagaaaagaaaaacccaggctgggcacagtggctcatgcctgtaatctcaacactttgggaggctgaggcaggcagatcacgaggtcaggagttcgagaccagcctggccaacatggtgaaacccagtctctacgaaaagtacaaaaaaactagctgggtgaggtggtgcacgcctgtagtcccagctactcgggaggctgaggcaggagaattgtttgaacccaggaggcagaggttgcagtgagctgagattgagccactgcactccagcctgggcaatagagggagactccatctcaaaaaacaacaaaaaagaaaaacccattttctgaggagaaactcaagcctgctgcataaatttgcataagtaatgagaagccaaatatttatcaccaggacaacggagaaaatgtctccaagacatgttagaggtcttcatggcagcccctcccatcacaggcctggaggcctaggaggagaaaaaatggtttaacaggctgagctcagggcctggctgctttgtgcagtctcaggacttggtggctggcatcccagccatggccaaaaggggccaacgtacaactcagaccattgcttcagagggtgcaagccctaagccttggcatcctacctgcagtgttgggccttcaggggcacagaagtcaagaactgagctttgggaacctcagcctagatttcaaaggatgtacggaaattcctcaatgtccaggcagaggtgcactgcaggagcagagccctcatggagaaccactgctagggcagcacagaaggaaaatgtagtgtgggaggtcccacacagagtccccactggggcactgcctggtggagctgtgagaaaagggccaccatcctccagaccccagaatggtagatccaccaacagcttgcacggtgcacatggaaaagccacagacacgcaatgccagcctgggaaagcagccaggagtggggctgtaccctgtaaagccacaggggcagagatgttcaaggctgtgggagcccaccaggtcatcagcatgacctggatgtgagacatagagtcaaaggagatcattttagagctttaagatttgactgccctgctggatttcagacttgcatggtacctgtattccctttgttttggccaatttctcccatttggaatggctgtatttacccaatggctatacccccattgtatctaggaagtaaccaacgtatttacccaatggctgtacccccattgtatctaggaagtaaccaacttgcttttgattttacaggctgataggtggcaaggactagccttgtttcagatgagaccttggactgtggacttttgagttaatgctgaaatgagttaagacttcaggggactgttgggaaggcatgattggttttgaaatgtaaggacatgagaattgggagggctcagggacagaattatatagtttggctgtgttcccacccatatctcatcttgaattgtagctctcacaatgcccacatatgtagtgggaaacacccggtgagaggtaatggaatcacgggggcgggtctttcccacgccgttctcatgatagtgcatgagtctcacaagatctgatggttttttaaagggcagctgccctgcacatgctctcttgcttgctgccgtgtaagacatgactttgcttctcctttgccttccaccatgattgtgaggcttctccagccatgtggaactgtgtgtgcattaaacctctttcctttataaattactcagtttggggtatatctttattagcagcatgagaatagacaaatacaggctgtttcagagcttagtgtgtcctgctgatgcttgcacagtcctttggaaccatctgtgccctgcagtgagtcctgttccttttttcatattagctctgaaaccaccctttacaagtattttcaaactatctgaaaaacagcacttgattttcctcagtgttacagatgcaggaagccatcaaagtattatttgtttcaaagctctatgaatttttaggcaaatgtcactctatgaatttttaggcaaattcaggcaaaaaacaagtaaattctcatttaatatgccatatgtttctggtgcctaaactcctcttggagaataaaaggaacctttagaacactgtgtggcctcccacactcttcaaggcacttaccttactctcgaggaataacagagacatctaggtaatcttaattaattactactgacaggatgggagagaagtgtgtctaaggcacttatcagtatcatcaacagaattacatttagaaaatctgctctgtataggaaattgtgctccatagtgccctggggaaaataacaataacatatgacacactgcctgccttcaaggaaattattatctgggtgaaaataagatagacacctgtgaaggtaaatagcaaaacgggtggtatcagttacctgcaaaatgagaggtacgaggaagtaatccagaaaatcagagtagtatatcaccccagcattggaaaagacattaaaagtcttctagttcagtaatttactgatgcttgagttcacttgcaacataagagttcacatttattgagtattattattgcagacattgttcaaagtattatgaaaatacatattgaaaatatatgttcattgtttcacataacattttcatgagctgggattgtttacaaaggagagaattaaaaatcagaaaacgtgaataatttgtccaaagtcccatagtcactaaatgatagggcagtggttcaaactcaggtcttccctacctagagccagtgcccttcatcagtgtaagatagtcatgctggcctctccagtcatggaggcccagacaattcccagtggctcattccatcacagggagatggggagaatagtaagggtttcatagacttgaatgttccagaaagaaggaagtcaaaaagttaaaattaaagaaatactaattaatattttaaaaggcaaattccaaaccacacatgtaatctgtagaatgcagatttgtacacctttgagggaactcaactttcaactatcagaatcagtcctgggtagctaggatgatggtttgagaatagtgttatttttcaagatctttgcttctgtgaaattttaaaaggtaattgaaatattgagaagcctatgaagaggtgaatttaatataatccacagaatgacaaatgtacatttagaggatttaaatttaggaatgatgggcaactgatgcaatggttactattggccgtttgataaaagttctttggttttggaatttatttagtatccaacaacatcttttgctaaatctatagctctcccttgagttttatcttttctcttgttcattggtttatttaatttcaaagacaattacacacgccaaagtaatgatcctacagatgtataagtgtatcctgagatgaataaattatggacattttggtaattagcaaatggaaggggagcagctggatgcttaacacagatgggtttattggttaaaataaacttcagtttgcctttttttcaaattaagcaatattagccccttttgttgctttgtgaacaatcaaccaaacagcataattctagatggattgctctttgattgccattgctaaatctaattctaatgatttaattgtttttaatttctctgtggcctatatgtgtgggctgtgtccctgtctgtgaggcttaaaatctgaggaaaaacatgcttcatattctcatgagcaaagtattcatatgtgatctggattgtagctttgtgccaagcttcttctacaaatgagaatgaaaggaaaatttgtcgaatacaattttaccctcttaggtttttctttataagaaataacagttcagtgtgattatgtaaaatcattgggaatggggtgatccagtgttttaagaatacgtgtgtaaatataaaagatagaattattgattaaaatatccttacaaaataatcatgtcacttcactgcaccaaatggcgatggatcacccccttctataaaagaaaaaacaaaacttccttgacagcgcattaaatgtcttgcataatccgaccacagtcacactgacttggactagatattggggaccccaagtgatacaatgcatgcaaagattgttgaaggagccctttggatctgggttaaactgtgacccagcacatgctagttgagcagcctcaaacacgtgaattaaactgtctaaatgtggttttcctcactgaggggggataataatgctacctttcctacaaggtcgtaagactagatgaaatgataaaaagggcttagcacagtgcttggctttatgctccatgcgtgatctacttacctttcgtttctgtattgttgctgctgttgtaacttttattatctgacctctcatgcgtatttgcacctgaagatctgtctagagtgctcttttgtcatctgaatgatcaaattccataaatctttcaggactcagctcatcggccatctcttccactacattttgccagtcttccctagctaaaagctaattcttcttctataaaagcattgcaattcttattgtcagtgacagtcatttgtacttaatccttacaggcttctttaggtatttatctcttcatgtacttctcagtgagatagcagactccttaaaagcaggaactgaggcaatttctacatatcttttgcagtttctggcagaattgcaagcaatgaatatttgttgttttattattttttatccttcatggttgggaattatatgttgttttaatcaacactcaacaaatccagaatgcctcatcattagatgaaatggccagagttaaatggcaacctaatctgatagctcacatttattaaacattactgctaatgttttttatgtcccagacactggttctaagcacttcataagttttattttctttaatcctcttgcagacactatgaggtctgtattattttaattattttagatcagaagataataaagcacagaaggttcaaaaaaatttttccaaggttatatagtcagcttgagattgagccagggtttaaatccaggcagactaagtccagacagagaccatgctcttaacctctattcaattctatctatccattaatatattcagtcatcttcttaggttcttttcaactgggcaaaacccataaagctgagaaataactatggcagatgtcatttttcatccttttagggggcatattatgtaaatatgcctatttacataataaaaaatcaagtctatagataatgagacaaaatattttaaattaagactgccttggcaaaaatctgggtacaagatgaaaataaaaataggtaacacattttgaggtatcaggtattaggctgataaagtgaattttcatattttggttattactgctgagaaagagaaaaacagcctctggcagctgggagctagcttggcattatgagctgggccttgatgttctcctgtgcacataaactatttcacagagcatcagcgttagcatcagctaggaccactctctgaccaggatggatccaggcaaaaacatcaccactccagaggcatgtctgaacccagacagaaacaagaacattttccaaaccacaaaattcaccaaacatcctcttatcctggctaaagtgagaggctgctgctgctttaccagtgatagctttagccttctctgttcctcctgtcttctggatgagaattattaagatactgagtcacaaaaatgccactgctcctgaaaagcatcccatccagaacaaagctttccttctttgagccttttcctaaatcacttaggataaaccccaattctgccagttctttctaatattctcttactgatgtggcccccagatccccatgatgtgagttgccccgcactggaacatttcaataaaccagttctccaactacaagtttcctggtgctgtgaatctggagagcattaacactattattatccttatctcagcaatgaaggaacactgagtaaggtcaaaactactgtttgattctatatttaaacccagtttgtctctattgctgtcattatttttgtttttgtttgtttttattacgtaggctccggaaactgctctcttaaccactacgttatacagctcccttatggttactgcaaacacagataaataataagatgagaggaagtgaccgtctactgcattactatcacgtgctacctaaattgatatgtttttctaatttaaatctcacaaccctttcaagcaacaatccttcttttacagaagctcatttcagctattaaagaagtccatatttaaaaatatgaagtaatttccctttataacagaagtctcatgactagcaagttttgaattttaattccactgtctcaggtaatatactcacatgcttacaccacattggaatagttattatctggaaaggagctgaagcaagcactgtcttagagcatcgtctggtctggtattgctccttatttcttggtaaggtccagcaagaaacacatgatcagaatgcaccttctttatatttccaactgctgtttgttctttatcacaaatattagaattggggatgccttatctccttctttattatctattgagattgactcgattttgagagtaggtcaattatcacgatagaacttttaatcttatacatataatggctctgactttaaagtttctaaaagaaaattgagaaaatataattaaatgtatgtttcagggaatggggcctgtctaacttatgatatcaataaatgctataataaattatccttattctaaacaattgctgccagtcctctgaactatggcatgacgataactggagtatcttgggatcctggggtgcttctatcccaagagtatgtgaagtcctgtttcatttattttatatttttctataccaaaatcattttccgaaagactacaagaagaagaaaggaaaacaggaagacctaccatctcagactcctcatttttatgtgataccaactttcaaaataagttctatttaggtgatagattgtttggtgaaaaactacttaaaactgtatttgagcaggaattctttgtgataccaaggaggactagatagatatcaagtaaactcctgatttagagatgagaactagatagatattattaagtcaactcctgatttcagagatgagaactccatagatattattaagtcaactcctggtttcagagatgagaactccatagatatcattaagtcaactcctgatttcagagatgagaactcaatagatagcgttaagtcaactcctgatttcagagatgagaactcgatagatagcgttaagtcaactcctgatttcagagatgagaactcgatagatagcgttaagtgaactcctgatttcttacagtctctgctaatctgctcactagcatggctaaaggaaatgttgaaattttaactagaaagaaagtatttgactatttgaattttcatactcttgtttaaaatgaaatagtagtaaaacatttgggaaatgtaattaaaattctggttctaaacatcttcatgaagatgacatcattagttatgccagaattcctggactgatttttcagattaagtgttgtcattaatgggcatcaatctgtattgaggaggttttttttcctgaaaatataaacattacatacattatgagtgacaacaaatcttcatgtcatatagagaaccatttacacttcatatctgtgaacattcatgtatatattgaacaatgtaattcttaatgaaatattgatttctaagtgccatttacttataaaacttgagtcatgatttcagtttaagttggacaacaaactccaaaagaaaccctgcagccagtgtgtctcatgttttaggaagtgcccaggcagctatgtggtattttttccaacacagagcactcaagatccaggtcctgcagatgaaatttgtagccttaataaacatatagggttgttgaacagtaaaggggtttatttgtacttttatgagtacatttttctcttttgtttactaatgaactaaaatttttctgcatgaaaaagctcaatatagatgtagaaatcttttagagacatgacaaaatgtactacgtcagagccaccagtactcacgttaagtagacagatcacacagacagcgatcagatttcacgttcaagagttcatcttgagttaccgttctatagactcagaatgaagatcacctcgcttattaaaggcaataaaagataaagaaaataggaaataagaaagacttgattaaatggccatttcactgaattcagcatgagtcctgcacaaattagacatttagattaacagcttctttgattattagaaagcctggaaaatggggtctgacaggattatagcataagctcatttataatgattcattttttggaatgtagctttttcataagccaaatagaaattacacatacaaattcatatttggaattttgttcttatttttgaattttgcctatcttttcaggtgtctgtgaactcaagagaagcctttcattctagacatagtagttattttctaaatcatctttaaacttatttgctggaatattgtgggggtaaagtgcaaacttccccttcaccatctgaaggtttgctaaaaatcaacaggcagaaggcgaattaacaggagaaatggcatgccaatttgtttgatcacagttttacatgaagaatgaagacccaaagacacatgagaaattgtccatttttatgcaacaccagaccaggcgatgctctaagacaggtacaacaaagtatggacatgcgtgtagaaatacgagtcaactaaagggtgtgatctactgctaataggctgagtggggacacccagactcttcctggcccctgtgagcagcttcctttccttctggtgtggggcaggaacttctctggaatggggatcttctgacccacagtcaaacaaggtaggtcacagtttctttatggccagttcttacacagaatggtgggggaaagttagaataatattcttaggttttatggctgtctttgggagaaggggttttggtttctctgacgcaccttagggaaagaaaatttctagtttctctgtctagcctcaagagagaatgaggctcagagacataagggcagaagaaagtcagggagggttttttgccactgagcttgcttctgaggccatctctgaggccttcactttggggtgtcattttatgagccccagcaatatctttctaaaaaatatggaaaaggcttaaaagactcaggccattttagagctatataaacttgtataactaagaatggagaattgttactgaaagatactaggtctctttttatactaaatttataatacagtgtagctccctcagaaagaaaaagtgaggttcattcattcatttattcacttactcattcacaaatgtttgttaatcacactagtctcctctcaagtaagtgaaagataacatataatatacataacaggccgggcgcggtggctcacgcctgtaatcccaccactttgggaggccaaggcgggcggattacctgaggtcaggagtctgagaccagcctgcccaacaaggcgaaaccccgtctggacaaaaaatacaaaaaattagccgggcgtggttgtggcgggtgcctgtagtcccagctactcggaaagctgaggcaggagaattgcttgaacccgaaagattgcagtgagccgagatcgcgccactgcactccagcctgggagacaagagtgaaactccgtctcaaaataacaacaacaacagcaataataataatatacacaacaaacatattttgaaggtgataagtgcaacaagagaaaagagtcgaacaaggggaatggagactgcagggagtaggggagggatagtatgagtagaagttcattggtgtagacaggataagcctccttgagaaggcaacactaaaacactttttttttttttaaaaaaaaaagagaaatttctgtggggacatgaaaggtattaaacttgtacatagaggcagcagccagtgcaaaaactctgtaggaggaatgtgatcactccaggaataagaggggtccatgctctgtgacaggacaagaagagggcaggaagaaattaactggagtgatagagcaaggctgaccgtgcaggatcttgcaaaccactgtgatgcgaagtcttgagcttttaattgaagagaaataggaacccactggaagtttaagctgagaagtgacgtgatcgctgctgaatttttggaggattattctggttttgtgttgaaacttcagtagatcaaggctggaagtactggagaactgttgagaggccactgaaataatccaggtgagatacaagggtggctgcaccaaggttgtaactgtggagggactgatatgtaccaggtcttggatacatttaaaaggtaaaagcatataggttttcctaaaaaactggatatagaagaggtaagaaagatggaggagtccatcatttggcttcaggaacaagaagaatggatttgccattaactgcgatgggtaaaactgtgaaggaaagcaaaatatttcacccaaaatatatttctttggcatgcttcaagatggctattcagagaagctgcaaaccacaggaacagatttggaaagttgtcttttttatggaacgtttgcacatgtagagaaaaatctacagcaaagtaaatagcagatacaaaaagtctttttctaagcccacccttgtccaaatgtaggaaaaatacacaggagagaccaaaagtctaatatttttaagagtctgatgacaggcccccatctattctttttttttttttctttttttttaaagattgcattttgctatgttgcccaggcttgtctcaaactcttgggcctccagtgatcctcccaccccagcctcctgagtatctgagactatagccttgcatctgttctttttgagagctagtgcttcatttgcataacaagatcagctctgattgacaacatttcctcccctcattctcccatagcctgtgaggctacctccctggagctcacagaaactttgtcctaggccgttgttctttgggctcattcatttcccctgaaaattatttacttctgcattccccatctctgtcctccccagtgaagagggcatttaagccagacaaggacaaaataaaaaaataataatggccagtcacagtggctcacacctgtaatcccagcactttgggaggccaaggtgggcagatcacgaggtcaggagtttgagaccatactggccaacatggtgaaaccccgtctctactaaaaatacaaaaaattagccaggcatagtggcaggtatctgtagtctcagctactcaggaggttgaggcaggagaattgtttgaaaccagaagctggaggttgcagtgagctgagattgcaccactgcactccagcctgggccacagagtgagactctgtctcaaaaaaataaaataaaaaataaaaaaaatcacaagccaatatcattgatgaacttagatgcaaaaaccctcaactagttagctgaagtcaacaacacattaaaaagatcattcaccatgattaagtgggattcagcctaggaatgcaaggatggttcaacatatgcaaatcaataaacaggatacatcatattaacagaaccagaagcaaaaactgtatgattatttcaatagatgctgaaaaaatattcagtaaaattcaacaattctttattataaaaaccctcaataatctggatagaaggaacacatcccgaaatgataaagactatatctgacaaacccacagctaacatcatactgaatgggaaaaatttgaaggcctttccccagagatctggaacaagacaagaaggtccactttcatcatttttattcaatgtaatactgcaagtctgagccagggcaattaagcaagaaaaagaaatgaagggcatccaaattggaaaggaagaagtcaaattagacttgtttgcagatggcacaatgttatacttagaaaaacctaaagactccagcaaaatcagttagaactgataaatgtattcagtaaagttgcagaataaaaaatcagcatacaaatatcagtaacttttttatttttctgaggcagggttttacaaatgtcacccaggctggagtgcaatgatgtgatctcagctcactgcaaccttcacctactgggatcaggcaattctcctgcctcagcctcctgagtacctgggactacaggcacacgccactgcatccagctaatttttgtatttttttgtagagacagggttttgccatgttgtccaggctggtttcaaactcctgagctcaggtgatttactgcctcgcaaagtgctgggactacaggagtgagccactgcatctggtcaaatatcagtaacagttttatatgccaatagcaagcaatctgaaaaagaaatcaagaacacaatctcatttacaacagcttcaaagaatataaaacacctaagaattaatttaagtaaaaaagtgaaagatccacacaaggaaaactatgaaatactgatgaaaaaaattgaagaggacacgaaaatatggaaggatatacagtgctcttggattgaaagaagtagtattgctaaaatgaacatactcaaagtaatttacagattcagtgcaatctctatcaaaatatcaataacagtctttacagaaacaggaaaaaaaatcctaaaatgtatatggaactacaaacacaccaagtagccatggcaatactgagcaaaggaacaaaactggaggcatcacattccctgactccaaaatatactacaatgctatagtaaccaaatcaacatggtactggcataaaaactcatgcatgcactgatggaacagaatagagaacccagatatcaacccacacatttacaaccaactcattttttacaaagtcaccaaaaatatacaatgggtaaaacagagtcttttcaaaaatgatggtaggaaaactggataaccatgtacagaatcatgaaactagacccctgtctctcactatatacaaaaaccaaatcaaaatggattaaatacttaaatctaagacttgaaactataaaactaccggaagaaaacaatggagaaatgctccaggacattggtcagggcaaatattttttgtgtaagatctcaaaagcacaggcaacccaagcacagttagagatacagaattacatcaaactaaaaagcttctgcacagcaaaggaaacaatcaacaaagtgaagagacaatctaaaaaataattaaaaaaaaaaaatttgaggccaggcacggtggctcacgcctataatcccagcactttgggaggccgcggcgggcggatcaagaggtcaggagatcgagaccatcctggctaacatggtgaaaccctgtctttactaaaaatacaaaaaaaaaattagccaggtgtggtgatgggcacctgtagtcccagctactcaggaggctgaggcaggagaatggtgtgaacctgggaggcagagcttgcagtgagctgagataatgccactgcattccagcctgggcgacagagagagactctgtctaaaaaactaaaaaaaaaaaaaatttgcaaactacccatgtgacaatattaataactagaatatataagtaactcaaacaactcaacagcaaaaaaaaaaaaaccacaataatccagtttaaaaatgggcaaaacatcttatcagttagttcttaagagaaaacagataaatggccaacaggtatatgaaaaaaatgttcagcatcactaatcatcagagaaatgtgatctaaaactgagacatactctcatcccagttaaaatggcttttatcaaaaagacaggcaataatgcatagtggtaacgatttagagaaaagggaaaccttcgtacattgttggtgggaatatcaactagtaccgccactacagacaacagtatggaggttcctcattaaaaacctaaaaactgagctaccatatgatccagctccattgtactgctgggtatttatccaaaagaaaggaaattagtatattgatgacatctgcatgcccatcttgattacaacactattcacaaagccaatcaacctatgtgtctatcaatagatgaatggataacaaaaatgtagtacatatacataattaaataccattcagtcataaaaaagaattctgtcatttgcagcaacatggatgaaactggaggtcattatatcaaatgaaataagccaggcatagaaagacaaatatctcatgttctcatgcatctgtgggggttcaaaaggtaaatctcatgaagacaaagagtgtattggtggttaccagggcccaggaaaggtagtggggagggaagtatgaagagaggttgataaatgggtacaaatatacattctgacagaagaagtaagacccagtatttgacagagcagtagggtgactatagtttacaataatctaatgtatacttcaaaatagaagaaaataatttgaatatttctaaaataaagacaaatatttaaggtgatggatagttcaattatattgagttgatctttacaaattttatcaatgtattaaattatcacgtgtcctgaaaatatgtacatctattatgtatcaatacaaaaatttttaaaaaactattctgtacaggacaatggtctaaacacttggaatacaggattgacaaagccttctgaaatttacttcagaggaggaaatatatagtaaacaaataaacagcaaaatgaaaacctagagaccatgtgataaacagtatgaggaaaataaaactgagtcttatgatagcttctaatggagcgtcattgagtggggtgttattttaggttgagtgatgagcaaaggccctcaaaagatcacattgaactgaaacaatattgtcctaaaaaagagtaagccatggcaaattctagagaaaaagatttccaagcagagaaaatagctagtgcaatggtctggaggaagcaagaagctcagtatatttgagaaaaggggaggccaactgagctctggcacagagaatggaggagggtgataggagatgaatttagggaggcaagaaagcacccaactctgcagtggcctgtgggctgtacaagcattttagatgccagtccttggaggagtttccaggctgtgataagaccttatttgtgtttttgacagaattggacagaagtcacatcagggagaccagagactagagtattgcatcatagaggaaagacactgatgacaagacctcaggggagcagtggaactggaggcctgggagcttgggacgtgttctccgggtgaagttggctggccagctgatgacctacaccagtgccattcactcctcatgtgtcccccgggaattcatagtgtgtgtcatcaggtaaaagcaacactactttcagatgttttctgatctctttgagatctggacaacactactgtgtacatatggccagcaacaaattacactcaatgaatattttagagagcagcaaagtaatcaattaaaatgtgggtaaacaaaaatcactgtgatcacagctctgtctacatggttctttggtaaaaaattagaatcctggggattagtctgaggataaatattatttaaaaagcattttggttaaatagtaattagtaaattttgctctgccgaaaaatcatatatattgacaataaattttgtcaaatttattaataaccagtctgaaactctataaagatgaatcctcaaaatatggatataaaagaagggtttagttttgttttattttcagacagctatttttaaaaaaatagtaaaaatgtcaaaacaatctggttttattttattataaattacaaagaaaaaaatacttccctttttgttgttgagcttatctattcacaaacacagaaagtagcaaaagaggtttttgatagcacgccatcccccatttaaaatacatttaaagacatccaataatcatcatcatttagaaggaatccatcaaaacgtttcctattaatactcattttattagttcagctgaatggaaacagtagcatgcttacatttaagaaagttcattatgggttcgttttctttttaacaagaaaggggaaacaaaataatgcccaaacacacagtgttgctggagtcaaaacaaagaaaattcatcaaagcatctatgagagctatcctgggataatctattctagagaagacaatacaaattggctgcaattgacaggtcgtaagttcctgggggaaagtcattataagcacatcatagcacatttggccgattgctcagtgttccacacactgacatcaagaacacatttccaatccatattctgattggttaaatgtggtttaggcagcctttcagctttcagagaaatggtcaaattctttcttttcaaaattcccaggccaagtcataataatgtactgatctcatggaagtattcctgcagtaatcacttcgagttccttcgttgtgcctccactgctctttcattcagcaattgccgttttgtgtgttatcatagaagaataacaaagaattagactcatgactctgaacagaggcttgctttttacatgagtattattatttcatccttggaaatcctggaaaacttcttactattttggatactaggtccagagtctgtttgtttacagcatggatgctgactggttgcagtcagagggtgatatgccagtgcgtgaaggaaatagggcaaaatgtaaacattgtacgtttagtagtgctctttctgcaggcaaggagagattgattgatttctcaagtgcaacttgtctgggggaacatgggattttattctattttatttcatttcatttcatttcatttatgtttgagacagactcttgctgtgttccccaggctggagtacaatggcgtgatgtcggcccactgcaacctccgcctcctgggttcaagcaattctcctgcctcagcctcctgggtagctgggattataggcgcacaccatcatgcctagctaatttttgtattttcgtagagacgaggtttctccatgttggtcaggctggtcttgaactcctgacctcaggtgatctgcccgcctcggcctcccaaagtgctgggattacagatataagcctctgtgcccggccaagcatgggattttacaatagcatcgtaagaaattctatctttttccctgagtattcaatttacacccatgtttcgaatgagcagtgagcaccagcacggagatcggagccccgtgttacttgtacgtgaaggtgtcagtgcctgagtgtgctagtgctgctgatactcacaccaaatagcaaacaagagccggcaatctaacctgttaaaaataataggcaaatgggaagagaggactgaggaatctccttgaagtttcccttcactgatgggtgctaaagatgtatgccttggggttttttagatgacatcgatgtaatccccttcaaaaatagtgacggaagaacagacttcttcaccttattaatttcctgcggcatcaaagtccctttgagagtctttctgttccaatttttcctcaagttcacaaaatgttggctgtcagcgttattgtgggttaagacagaaggtcctcctttcctgaccccagagatcccagatcatcccagtgtttgtttattttctaaaatgtccattttgcttagaaataaacacaaattggtgacatttattccttgcactatcttctaacaatttattctaggtttactaattctcatgatgttctgctagagaaatatgaagaggcaatttacttgtgtagaaatgtgagtcaaatcaagtgaatattatcattgtcagattcagcatttatcagtcttccctcacaagattcagagagttctttttctgttcagtttggtaataagagaagttataatcaatttggtcataaaaattgtgcaaaattagatttttttattccactttctgctatgaaatattcttttgtttgttagtttgcttgagaccgtgtctaattctgtcacccaggctggagtgcagtaatgtgttctcagctcactgcaacctccgcctcccgggctcaagtgattctcccaccttggcctcccgagtagctggggctacaggtgtgcaccatacgcctggctaatttttgtatttttttttttttagagacagactttaaccatgttgcagaggctggtctcaatttcctgggctcaagtgatcctcctgccttggcctcccaaagtgctgggattataggcgtgagccaccacgcctggcctaaatattctttaaatatgtgtgactttggaggaaagggaatcggatgggttaaaatatgtgaagttcattgtcaactgttatccttgagaaatatttaagcttcccttaatgttgtgtcttaaatgacacataataatccaggaagggatttttatgaccataatgggtttttagcttaattttaggtagcaaagagaaacatctgctatggaaaaagcttaattgatttttatctgatgtcacgaagctgctacgaggcaccatcaccagcaggtgggtgctgattacgccctgtgccgaggactccgttttatgaaaaacatcaatcctgccatctaagaggagaagacatgctcaataagtttatctctgcctccctacccatgttcaacaaggtatcccagaagaacttaaaagctatttactctggattataatagatcctcttgacattctgtaactggtgaagccatgggagagtcctggcttaattataaacaaccacaaagttatcatcagtgctacctggctacaaattgtttcttgcagagaaaatttttagctatttaagtcccacgaaagtaaatttgggggctgaaaatttttaataagtatttaaacagcagaccttcaatttctctagacccagtgaaaacagaaaacaggatggagtatttgcttgccatgaacctttcctcccacaacaactgtgcattttaggaagtcagtagtaactagcttataaaatacagagctctggaaatcatatgcctcatcagactgtagctaatggggaagacacactacttcctgtatttcaaacaataaaaaccatgatgtaataaagagcaagtttatcctgaggatagaaagtagcccttacataaatgagtaaatcagtaaaataaaacaaaaagtacccctcaacaaataaaatacttttctttaaacttataatttgggaaattatcttaatgttaatcactgcttaataatttttaattagcatctgcaaaaatgtaatttaattttaagttagagatttcttggtactttaaaactaattaaatatttaattatgttgtttgatacccacatattacataagaaatgtcagtttatttgttaaatgtctcacactgaaaatctcggttagcacattcttttgagttttatgtttttaaagcaatatttgcaaaagaatttctcaaaagaagtcagtactgtttctggacagttcatgaatcatctaatggaagatcttagagctgatatttgtaccagaaaagatgttacacctaaaggtgctcattactttattcaatggacaagagaaataaatattatcttacaggtattatagaaatctttatctatttcactttctctccctgtcctagataaacccacacacacacacactagcaatgtaaaatccaaatatatttttattcaaacacgttaaatcaagcaacagaattctagtacagttttgctgtattggtcatgtctggcatacaaaaaatgtttaagtcttcaaaattattctggtatcatatctgtgatcccaatactcaactgggtttctataaatataccagtaaatattcgttggctactaactaggtgtctttttttgtgctaagatttgtgaaggatgagaaagtattctggagaggcatactaaacattataaacacttcctgataataatttctaaagcacgatcagagctgtccgtcatcatataaagatggttaaaaaaaaaaatccgccaggcacggtggcttactcctgtaatcccagcactttgggaggccgaggcgggtggatcacgaggtcagaagatcaagaccatcctggctaacatggtgaaaccccgtctctactaaaatataaaaaattagccgggcgtggtggcgggcgcctttagtcccagctactcgggaggctgaggcgggagaatggtgggaacccgggaggcggagcttgcagtgagccgagatcgcgccactgcactccagcctgggcgacagagcgagactccgtcttggaaaaaaaaaaacaaaaacaaacaacagcaacaacaacaacaacaaaaatcaccccataacaatatgctacaccatatccaggtgagaaaaatcaacaatgaaactgattttgcaaaattccactgtgccttctatagtcatcttcaaggtctggggttattgacatgctgggagaatgaacctgatattctgtttaatgactcagatattgtagacatatttcagacacagaaaaactactataccaatacatttaaaaaaaaataaactgtattcaggatttgtgatttttttaggcccatcaagagcaaattataaatttatttcaataaggattgcatgaactttgtggttttaaaattaagcttttatagacctgcttattaagataagcatattcatccaagattaaacataatatttccagtagaatctttgctccatctgaataatgagttaaactcagaattatagcaactttctgtagcatttctgatcttaacgcatgcaagtagatatctctaaaatatatttgaaatgggttagggacctttcattatggaatggctaggcagaaaaggactatttttgttacataccatttcctccctaacataatggtgaaatacaaactttaccaggtcgatttttgttatgcgggaaaccagtgtttctgcaagataaaaatgaggaactaattgtttatattagagccttaagactgatgctattttatatgcaaatttactagagcaatttgttttacatgtgtattacgtcaaatgaatcaaattgtctgaatgggtgaaactacgaatatagaccatttcattctatttgaaaataatttgcaattccgcattttatacaaatctaattgaaatataatcatgcctccgtaaaacagtgataaacttaatatatgagaacagttgttatgtgccaataaaatatcaaaaccaagcaaattatagaatagttatcaggatgactgtaaaataacataactagctctaaagctgagtcaaaaataattatttccgctgtaagaagggccatctagtagaacaaactacattttctgactgcagattgtttctttataaaatgacaatagcagattgtatcgagttggaccgtgcatttagagttcagaaggctcatgattacctgagccagtgccagcctcaattctcaggcccacgtgcaggactaaatggtttatggcctgcaacaaaaaggcctatggccatttaggaagtgaggtgttcggttatcgttgcagtaaaagaggtaaaataatcttttttgaatgataaagtcacaagtcattgaaaactgtgtgcctagttattatcagctgtttttctttcctcctttgactctttgtggtcagtgctaatgtaagtctttgcttgaacaagcctgcagtgcaaaaatggtttccagcagtgactggcagaaccaggaccctagacagttgcattgcaggaggaatgagaaggcatcacaaaatagaaagttctaacaccctagatggcattttgtgtcatcgttttctgtaagtgcctcttaatactcttggttttgttttgtgttttttttttttttcactataatctgttctttttcctttttttttcaattgaatctaacctaaatatctctatgagaaacttttgactcattaacaagataattaaatgatggagcagagtgaatacttttcactgggtgtcctatagtttgtaaatgcttgccctttcagtgagctttgaaatatttttaagtgtaacagtccttggtaatagctttacaatggggtgcaaatacagaagtcagtttacaagaaatttctgttctctttatattcacgcatctgagtccagaattctaaaagactgctcatcatcctacctataatacaaacaaggtgccctccatgttaactgcagaatcctgcagttacagtctagacacacgaaccttgcagaagggtgcatcggttactttacatactttgcataaacgaggtactaaaatcctcataattatccacctttcagaacatgtccgactcaaaatattggaagaacatttgagaagaatctacaggctagaatctttttgaatcttttcttttgcttgtttgttgtttgtttgtttgtttgttttcagttatttgggactttaatgttcctgagacaagaaaaggaaacatggaagcacgcacacttagaaatgagtctcagaaacggaaaatccaaccagctaaatcatcacagcactcctggcaaaattctctaatgataaaagttgtttgttttgttttgtttttctgatttttcttttcagacacattaataatctcttgactaggaaaggggaacccacaaaataagtccttcttcattcttgtgtgcagttaattttgtttctacatgtgtctgcaaaaggcaaagatgacctccaaagcagattctagctctatttggatgagtctgtgagttttggtcaatgaaaatgggcagaaatcctgtcacaggagagagctaagtagacaacctcattggaagttaaaaatgtatattgtcatgtcaacgcaaggaagcaattataggcctcatgccaactgcacatcgtctgtgtgagtccacgtctccaggattccgagtctgtgtgagtaagtgctgttcccacttcaggaggagcagtggagacaattagtaggaatgaagtctccttggtgtcagtaatatgaaaaaatataccatgatcaaataagcatgtaggaaaacacctacattttcaaattcaaaaactattggaaaacattaaactgagctttatgtctttacaatttcttttcatagcaatgcccagttaatgcgccattccacactttctgatttatcttcagataaatgagcttcttcagccgtttgcctcatgtgtcctccttgcccttagtagagagcagcacataggatgttttgatagactttgtttgtggacaaatacaagcaaagcagcaagctgaggaaagccatcattgcttttaatattttgtaaacaataggacttgcttttatagtcatattaataaaagcaaactattcttacagttcagttaggctaggattagaccaaaacaccaaacaaaacagctgaccttgcaatgaaaatgtaggcgaaaatcacgaatttgagaagagatgtttaagaaatatttttaaaataaaattgaaaaaatggaagagtaacttgtagcaagtgctctagtaaaaacttcctctgtatacacgtttgaagtatacagatgaacccagtagaaagagagcttggaggtgacgggagaaacctgattattacgataataataaggtcctaatgagacaggaagggaaagatcgaggggctgattgagcaggctgttggtttaattcttgcttctgcagccattcccatcttctggaaggaggcaaagaggttggttgtacatattacagtccataaaccagaatctatctgagagctgtcagccaatagcccattggaaccctaaagacccctaagtcctagagctagatataaatcctttagaactatatcagaaaaaaaaaactttcttatacattttctccatgtgagaaaaacattattatgtttgtgttttagcattggtttcacatctcaaaactttttgctaacatatggagtttgctttagttaataaaattaagtgttttttttacattaccagatgatataaaattcagcaaatacttttttatatagaaatggaaattatgctgtgttactatgtgaaatattaactgctcctttagctattcatctactggctcgggatgactcttattttaaatgctaatttttcagaatctttttgaagggtgttatatatgttattttatcacatggtcctgtgagatttgtatagtgtccataaaattgtgaagtgggcataggtttttttaagtatgacatataattaggattaaatattcacatgattatagggctattcttgcagatataaagccaggcaaattcccaatggataatacttcaagaaatatttgcatccttaacattaaatctgtcttactaagttaactttaaaattgctctcatgaccaattttgcatcctaaaggtaaataaataaataaatcaaaacatgacctaaaacataactaattgaacaagagaaaaaagtgtagaacacaaattattgatttcattttcatattttaactagttgttctttcattaataagtataatgtatatacaattttcccactgtttaattattcaaagattttaaaactgaattgaatacttcatgaactaaaaattataaaatctttattcctgaatagctggaaaacaaaacaaggaactttgtcttttttaatggcatagttctgtattaccttggtgactctaaactctatgctttattcaatttttttaattgttggagacaaggagaatcataatctcaacctgcatttacatagtgctggaagaaaagaccgaccgggaatgtgtgatctgtcacttggctttggaaacacttgaagaagttgcactaatgtaaaaaagaaacagaaagatttaaatctatagaatatactcattgcataaagatgaattcagcaaatatattgttgtgagcatcttctatggtgcagcgccaggtcctttatttatttatttattttatttatttatttttttgagatggagtctcactctgtcgcccaggctggagtgcagtggcgtgatctcggctcactgcaagctccacctcccgggttcatgccattctcctgcctcagcctcccgagtagctgggactacaggtgcccaccaccatgcccagctaatttttttgtatttttagtaaagacagggattcaccgggattcaccgtgttagccaggatggtctcgatctcctgacctcatgatccgccctcctcggcttcccaaagtgctgggattacaggcgtgagccactgcgcccggcctatttatttattttcaagacaaagtctccctttgttgcccaggccggagtgcagtggctcgatcttggctcactgcaacctttgcctcctgggttccaagaattcttgcgcctcagcctctcgagtagctgggattacaagtgtgcaccaccatgtctggctaattttttgtatttttagtggagacagcatttcgccatgttggtcaggctggtctcaaactcctggcctcaagtgacccacctgcctcagcctcccaaagtgctgggattacaggcgtgagccaccatcccaggcctagcaccatctccttcggaagatggaactccagtggagctcttactagccaggagcttagagcatgcatgcactttagaaaggaggtgtctatgtttctttcaaaattgttttccctcagacaattttatatcagagtgcttaagattttatgtaaactccatgagtgtaatgtcttttctttttaagaatagtaggaataacaaagatatagaatcaacccaaatgcccatcaatgatagactggataaagaaaatatgctacatatacaccatggtatatatacaccatggaatactacgcagggacatggatgaagctggaagccatcatcctcagcaaactaacatacgaacagaaaaacaagcatcacatgttctcgcttataaatgagagctgaacaatgaaaacacacggacacagggaagggaatgacacacacttggggctgttcctcatctagcacatccagtacaaagtatggaacacattttcaatatacgttttttggttttttggttttatttttatttttctgagatggagtcttgctctgtagcccaggctggagtgcagtggtgtgatctcagctcactgcaacctccgcctcctggattccagtacaaagtacgtaacacattttcaatacatgttttttggttttttgttttcatttttatttttctgagatggagtcttgctctgtcgcccacgctggagtgcagtggtgtgatctcagctcaccgcaacctccgcctcctggattccagtacaaagtatgtaacacattttcaatacatgttttttggttttttggttttatttttatttttctgagatggagtcttgctctgtcgcccaggctggagtgcagtggtgtgatctcagctcactgcaacctccgcctcctggattccagtacaaagtatggaacacattttcaatatatgctttttggttttttgtttttatttttatttttctgagatggagtcttgctctgtcgcccaggctggagtacagtggcatgatctcagctcactgcaacctccacctcctggattcaagcaattctcctgcctcagcctcccgagtagctgggattacaggtgcacaccaccacacctggctaattttttgtatttttagtagagacgaggtttcaccgtgttacccaggatggtctcgatctcctgacctcatgatccacctacctcagcctcccaaagtgccaggattacaggtgtgagccaccacacccagcctaataaatattttttgtaatgaaaacatagataagtaaatgagaagtgagataaaaataaaatgaaatgaggcataaatgcgtatggagtggagagggaaaaaggtcaggtagcagagggccagagatgagaggcttaggaacaccagaattgtatatggatacaactggggttcagccagctcctgggtcaggtgactgtgcagggagctgcttataaaagaggaggcaatagttctgttgcttttcttcatctcagaagaacagtcttgatacttaggtatgtttttggtagaattgttgtgttaataactcttctttaagggaaaagtatctttaaattattgccacattgccacgtgattgtgattaggagttttagcaatttcctaaaaaggtctactttcaaatgaaacatttggagaagtttttgttttcttttgtttctattgaaggaaataaagcgttgactagttattttcaagtttggggaaccataagtgcatatatttcctaaatgacataagagctcatttactgaaagaattaaccaaataaaattaataatccaaagaattgtcacttaatatctataatatcctgatacaactacattgcaaaattcaaaggctattttttacaactactttagtgagattctactttctgaataagttaaattaatgaatataatcttataatttagaaaacaaaacaaaaatgttctcttttcccaagaaatatacctgatttaatattttgcctctattgtacaaaaagtacaagtgtacttttgtaccatctttactcttaagggatatctggaaaaatattttaacaatcccaagagaaggctgattgcaaaaacagaacttatttctgcaaattctaaggtcctctctgtttgaattagaagtcctgcagccagccaaagcaattccttatagtctacattttctgttcacagatttcatttcccacgtttcctgtcttcaaatgaagcaatatagaacggggtaattgaacaggctttaggatcttccagtttgagttcagaccctgtctcattgcttaccgggatatgggaacttggcacctcactggacttcaggaagcctcagctttcctatctggtgtgtggcaaatgtccaaccacgaaggcagcacttcactcagcatccagtacagaggaaggatgtcagcagtgctgtagattgtcattacatgtttgctcaaccaagaatgtttccactgagtgaggctgattgggaaaaaatattatagggcggttcactcaacataacttctcaaatctttctgcttattgaattatattaaaaattcattttcactagtaatttgagtctcaaaatctgaagggctgggtgcagtggctcatgcctgtaatcccagcactttgggaagctgaggcgggcagatcatggggtcaggagtttgagaacagcctggccaatatgataaaaccccgtctctactaaaaatacaaaaactagccaggcgtggtgacgtgcacctgtagtcccagctactcgggaggctgaggcagaagaatcgcttgaacccaggaggcggaggttgcagtgagctgagatcacgccactgcactccagcctgggcgacagagcgatattccatcaaacaaaacaaaacaaaacaaaacaaaatctgagtcttctatgcctctcaaagaaatagcattcaagcttaacatagaaaacaaactcattgagggtgcataagcagacctgtatactcaggtctgaaaaagtcatctttctcttaagatgcttgcactttcttgcctgatttaagttatgttgaataatctcaaataatataagaaaaataactatttaaaaagtagagttatgagcagcggggtacaggagcaggaatcggcttggtgcttaaagaaatatataatctaattccttaactcctgtaaaataaaaccaaaatgtaggtactaagttcagttatatttcggaggctaacattagcctaacgtactgtgctgtaagacctggttcctaccaccacagaacaacgtgcagttagaatccagcctcgttttccctctctctctgccccatgagctccacctgactttttgaaaggccccctccctttgagcagaacttggttcctcattcaatccaattcccatttctttatccttcctcctgagctccgttttcgaaatccgtttttccaccctcccttgtaggtctaatgcctgttcctgtctctctacactgcttccattatggtaacctgcacagtcttaacttgaatttctttcagaaatataataattctgccaccgcatcacttctgtttgtttgccctaatcaaggttaggcatttggggacacctagattcaagggatgctgggaaatacgcataactgaaagacgcccagcaccgtcttgagaggatttgttcttaaaggaaaaggcacacatgtaacctgttagataaagagctgcctccaacaaagcagggaagaagagaagacaccgtgaggccatcttgctgtggcctaggatcggggtccccaggctgggtgtgagtcttccaggcctgaggactcaccttggttctcagggccagcctctgcggaggcacaagtcctgatagatctccttttgcttctggcacggatttctctgcaggccccttgcctgcgtccctggtccctcctttccagtctccttccttgctccctcccatcctatgggaagtcggtatcttagcagatgccacatacttgcctcctaacacatctgtgataccaaatgccaactttctggagcgcctatcttaaaaaaaaaatttcaatttttattaatttgtaggtttttttcatacagtaaagttaacttctcttctgtgtgcagttctatgagctacagaacagctcctgggcaatccctcatactgtccctcatgctctccctgacatcacctcctggtgacattgatgttctccacccctatcggtttgccttttctagaatctcatatgaatgggatcgtccagcgtgtacctttctctgtgcatcaatacagcaggagttggctcctctccctgagtgcacgtcagtttcacttctgctgttgcacctgtcaattgttcgtcctactcatgccactgcggggctccaccatggcttatttattcattcaccagctaaagggcatttgggtttccagtgtttggtaattacaaataaagctattacaaacattcatggatagttttttgtgggaatgtaggttatttcactggggtcaatgcctaggagtaggacttctaggttttttggtacatacgtatttaactttgcagtaaactgccaagttgtttttcaaagtaactgtaccattttgcatgtccaccattagtgtatgacatgcaaaatgctgtggctggagaacctttgcatctacattttctcctctctcaatggtccatcttgccctatcagcctgtctgttaacactacactcacatctctggtttgaaacttcatatctattatttaagttagcaaacattattcaggaccagctatgtgttaggttactcttcctggtgttataattcagtgatgaatttgagatttaaattccataaactttatagattgacattctggtaacacatgcatgcataattaaatggatagacagatctataaatttaaaaataaatttattttagaatctgcagcatccaacatagtagccctcagccacatgtggccattgctccgtgaactgtggccaatatggacgcaatgagctgtaagtgtaaaatgctcacgaactgctgaagacttaatataaaatgacttatgatttttacattgattacatgttgaaatgacaatagtttaggcatacagagttaaataacagtaaaattaattttactgtttcttttttaaaaatataactatgaaaacatttaaaataacatatatggtttgtattttatccatatttctatcgctatgcaccatttttcatagtgaggtgtaataccaaaaactcaaaaaagcatgctattacagagcggctgatgttacagccagataatacttttaatacaagagtcaggaaaagttttccgagaccctggcatgtgcagtccaatctggatgatgggaaagaggcaggcatgtgacggtccgagggaaatgtgtccagctgaagaaacaggacaagcttggtcctgaaagagcaatgaactctgggtgtttgaagagtcaaagaagccagtggggttgaagtggagtggtgaagagaagaccggtgggagggagcgcagagtggtctgcagaattcagagcctcagaaaacgtggtaggaaacatggattggtaccgagccaccactcttcccagggaactcttgcaatgtctcctaatccaacaacactccctttattcattgccgccctcaaatatgaagcatgactaccatttactaagctcctactaagtgccaggtgctgaccacactcggcactctgtggcttgctccagttggaattcaggcttcctttgccattggcagaggttctctcctgttagcatcgtttcttcacttgccctctgggatctgcattctcctggccctgtgtcatccattatctccctgtctagcaagttagggccaggtcaagaaaacctgtatctctcaccttcatagatttttgccttcacctttaccctggttgatatacgagatggatgcactttagatttttaatctaatctattgatgttggagctgtcaaaagacccaagtttcatgtttttagatacacatatttttcccagtagaacctctttgtaatcaagatgcttcttaaaatcagcagctgtcaagagagagttgtgaaactgttgcctttgtcagcacttgagcaagtgtgatcacaggttcattttctcagtacgtgagcaagtgtgatcccaggggttcatttctcagcacgtgagcaagtgtgatcacaggttcatttctcagcatgtgagcaagtgtgatcacgggttcatttctcagcacgtgagcaagtgtgatcccaggggttcatttgtcatgacttcaagtgagttgtgcatgttgcgtgttgtgatccatatgtggagttttgatacttaacatatctgcaaatagattgcactataatttgtctttgaaataagttattgtgtttacagaaagacagggacataaaactataatccataaagcacacagcaattttatattatataaaatataacagttgatattagtaaaaaagacactagccattagagaaataaccataatttgatattttcttataaatcatcaacagagagttttatataagacatctacaagtaaatgaagatatgctgcatttgactactgctatgcaggtaaaactactacctatagtgtgccaaaaaaaatagaactggaggcagggaatattgctcagtcccaagagagcaccctcttgatggcatatactaagcaaaagacacagccaccaagtcacaatgttttcttataaaattcacaatcaatatgaagatttaggcatacatttccagtgtttttggcttatagcattgtttatattccacaaaaataccatatgattttaaaaatccttatctaagtttagaggagctctttcataagtataaaattttaaaactggaagtgattaaaaaaagcatgtataaatgaattagcagcattatctctgctagtagtacagaaataagggtgtacctttcactatacagttgatccttgaacaacacaggtttcaactgcatggttccacttataggcagatttttaaaaataaatgtattggaaatatctttagatatttgtgacaattttcaaaaaacttgaagatgagctatgtatcttagaattatcaaaaaatgtaagaaatgatatgtcatgaatgcctaaaatatatgtagatactagtctattttataatttgccaccataaaatatatatgaatctattattaaaaagttaacacttagagaccatacacgaagccattcacatttgagagaaatgtaaacaaataggaagatgcagcattagattataacttactatattcgttactgaattcgtctgttttcattgctataaggaagtacctgagattgggtaattaactaaaagaggtttattttggctcacaagcgtcagcatctgctcctgatgaggccccaggaagcttccaatcatggtggaaggtgcaggggcagcaggcgtgtcacacagcgagagagggagcaagagagagagtggggaggtgccaggctcccttcaaaataaccagagctcacatgaactcacagagtgagagaataactcatcaacatgagggcagcaccaagccattcacgagatcatccccaccacctcccactgagggctcacctccagtatttgggcatccggaacctctggtgaggcccgcaggaagtttccaatcatggtggaaggtgaagggggagcaggcatgtcacatgcagaaagagggagcaagagagagaaggagaggtgatacaggttgcatgtttgttctctccaaatctcatggtgacatgtgattctcagtatagaaggtgaggcctggagggtggagactagatcacgagagaagatgcctcataaacagtttagttccatcccctcggtggtaagagagttctcgctcagttaattcatgtgatatttggctgtttaaaagggtctggggcctcccccttctccgtgtcactcgttctcttgccatacctcatgcctgcccctgcttcaccttctgccatgattggaagcctcctgaggcctcaccagaagccaagcagaagccagcatcatgcttcctgtacagcctgcagaaccatgagccaattcaacctcttttctttataaattacccagcctcaggtatttctttatagcaacacaagaacagcctaacacaggaggcgctaggctcctttttaaaacaaccagattacacatgaactcagagagagagaaattccctatttacggtgaggacagcaccaagccaggcatgagggatctgtccccgtcacccaaacacctcccacgaggcccgcctccaacatcggaggtcacatttcaacatgagatttggaaggggcaagccattcaaaccatatcagatacctactgtactgctgcaataatattattgtcgtctcccattgctactataatgagctcaaatatccacctacaacactgcgtgatgctaatcatctctgcttgaggaatttgtctttccagtaaattctgtggtgtagtgaaaagtgatttctcaaggttcttgtgtatttttcatcatgtttagtgcaatatcataaaccttgaataacaccatgtggcccttatgaagtgccacttgtaacgctggaagtggtcccaagaagcagagaaaactcatgacattacaataaaaagttgaattgcttgatatgcaccatcaattgcgctctgcagctgcggcgacaccattttaagatgaatgaatctggtgttagggctcctgtaaataaagaaaaggaaatttgtgaagctgtcactgcagctaaccaggaggtgtgaaaatcttgcacaaaaggtattttgtaaaatacctttttaatctcactttgaaatatagcatttatgagggtgcagaatggctatacaaaaggcatgtctatagattctaatatgatttgagaaaaagcaaagtcattgtgtgacaacttaaagcaaaaagaaggtgaaggatctaaaactggagattttaacgctagcaaaggatggtttgataattctagaaaaaaaggttggctttcaaaaatgtccagataacaagagaagcagtttctgccaaccaagagccagcagataagttcccagatgccattaagaaaatcattgaggagaaaggacatctgcctgaacaggcttttaatgcagacgaaagtgccctattctgggagagaatgccgcaaaggaaatttattagtaaggacgagatgagtgctgctgagccagtgccagacgatgaggaaggagatgtaggaaaagcagtcctggaaaacaaattggcatcagacagtctggcagagggttctgatgattcgaaagagcttttgtcttctttcactctatgggcactcctatgggctctgaaactacaaaaatcagtggaagaaggattgatacaataaagacacttttttagagaaatgaagaagaaaagagtcaggcagaaattacaacatagctccataaagttacatggagtgtgcctgcctctcctgtctcccctcccacctcctccacttcttccacctctgccaccccgagacagaaagaccagcccctccccgtcctcctcctccccctcagcctactcaatgtgaaggtgaggatgaaggtgattatgatgatccacttccacttaataaatattaaatgtattttctcttccttatgattaataatattttctttctctagcttacttcattgtaagaatacagtataacatacataaaacataaaaaatacggttaatcgactgttcatgttattggtaaggcttcctagcaacagcaggctaacagtagttaagttttggggagtcaaaagttatacatggatttttgactacatgggcgttggcacccttcaccctcacgttgttcaagtattagactccttgatgccaagatgtcaaatgagtctagagccatatggaaattttctatgatcaagagtgaacacttgtgtctctcaccttaaacattctctggccagcaggccagtaaggcagtggaaagatcaaaaggaggatttcccattggcacccgctcaccttacgctctcatcctaaggtcaaaaatcatccagtgattttcaacagcagtaatcatgccctcatgcccaggagccacggaaacaggggaaggaaggaagttggggtcacaaggacttgggcagcagaagatatttgttgataaagctgataaatgttttgaaatcccaaggacagttctgcataatgaagaattgtcccagccaaaatgtgagtaatgtcctgttgagaaacctggatattatgtgtggcttgagcttactttatagatgcagtcctcttacttatcaggaaatgctcaagatgcctgtgctaggcctgacctagctgagctgttgacttgaatgtgcagaaggaagtcctaatggtacatgagcacctctcacaccattcagagatttcctcagattggatcactctgtctagtttctgtcatttctaaatacttcaaaaagttacaagtaccaaaggcaggggagcatcggcagagatggggtcacagtgggtattctttataaaaattttgtctaatctgtaccacagacttggaagaaaggctttgttggacattaaggtgagcagggctcatgcccatacaggtggctagctaaggaaaacgatgcttcacagtgtcctgcctgtgagtcagcagggctggactctacacagcaatgtacactcggatccctgactttgttagcacattgaaaataatttagtctctcaggagtggatcacacaaatcatgatcactgacactcattgcacttcactttcagattgtccttgccaacagagaactgcattcccttcatggaggcaacctaagtgtaaagtcaccttattagaattaacttgacatccttcaccccactttgaacattcaaagatcaatataatttcgtaggataatcccactcctaggaatgcatttctctttattttgcctcatgaaaatcccatgcaatacttccttcaaagcaaaatgcaaaggctattcttttgaagctcattttattacttgatttgcttcaccctgaacacctaatgctcgtcaatagttccattcctgtgtcacttagcatggactatattccattctagtcatttaagaatatctcattttctctactcaattgtaatctttttgaaggcaacagccataatcataaattaatttttacaaagaacctagggtagcaggtatcaaaaaatggctatcaaattatgagaatctttgccttagaagatgaaaaatacttgggagatgaaataataagtttgagtcaaattaggtggactattaaatggtaacattaaaagtgaagtctgacttggactctcagtcttaactctagattagtggttctccaccagggctgttttgcttctcaggggacatttggtaatgtctggagatattttcgtttgtggtagagagatcaagagtacttctaaatagcttataatgcagaggacagcccattacacacacacacacacacacacacacacacacacacacacacacatacacacacttctgacccaaaatgttaatagcatcaagatggaaaatatctgttctagatctaccaaattaatttcttttttcttgttttcatgggctagctaagtttaaggacctatggagtccactgaggatattctttttaggtaatctcaatgttgcagaaagcgtcattattatctttaccatcattatcatcataaccatcgtcagcttcaacagcagcaacacttcatcaaaattaaatattgtgatagtttgagaaattttagggaaactagagcataatcttcacaattctgaaactcagggatgaaaactgtgtgtgcagtaatcttagaactattgaatactagattagggggaaactgagagggcagctgtcattatttctgtcatttcaaacattggcatcactagtacatctagcaccttccattcaaagatgagattagaggaaaaactattttagagtcaaagatttttccttgtaggtacatattttgtagagaacaaagttctctatctttcctgtatcatgatctatgcatcttaaaaagtgtcaagaaatttctttctatttaattcagtttttttctggttggatcccaaagcattttttttttggtttgctcctctatgaagcttttctctgcctattctgtataacaactgtttacaggtttagaaatgcatgagcaaatgtttttgcaaccttctcttcctgaggaaaaataatcaagtgaccttatcacagcctcctggtatccatccttattttgtccctgtcagtttattcatctgtcccctctcttaatttcttggttcctttaacctatgtatctgtagtctgcaacacacacagatacacacacacacacacacacacacacacacacatccctctacaggacagttatacaaaaatgcaaaatgaaagaagtggagaatagagtatttacgcaatgaaaaaaagctgaatcctagaataatgaataaagagaattgtgggttcagattttcaaagtatacttagcttagtgacagtgaatggaaacaactgctatgttgaatgacagaatgattcaatgaacttgagttctttcactctgggccgcctcaatttctgcctctgtttctgtctcttgagcaagaatggtgtaggtttcataataagcatggattactgaatagatgtcaggaagagaatatttgtcctctaaatcaagtattcaattgactttctatagatctggcatgaactatgatgtagtccaagaattaaaaacttttaaagtagttgtagaaaatggtttctcagtcgtccagtttttcaggtttgccagtcccaagtgtattagcaaaattctgtaaatgcgaattatagagttaaaaacactagaagaggaggaaaaaataggtagtggtggatgaaaattttgtgcaattgataagaaaaatttttatctaggctctccaggaaccagctaactgacttgggctgctcactagccctgtctgggtcttaatgtctttgtccttaaaagggaatatatggtgttcatctgctgccagtagtatcatatgtcattaatcttttgggttcccatatggctctagatatgatgcattttgatgtcctataaaatgggacatgttaaaagttatatatgaaagcacaaattactaacatcaacaacgaaagagggaccattactacaaaccccatggacactaaaaggatagtaaagggatattgtaaaaaattctatgcccacaaatttgataacttagatgaaatggaccaattctttgaaaaatacaatctaccaaaactcacacaagaagaaataaacaagctgaataagttcagaaattgaattaaattacaaaagaaattgaatcaataattaatcatctaaaacagaaaacaccaggtccagatggatttactggacaattctgctaaacatttaagaaataaattttaccaattctctacaatctcttctagatgccaaaagcagatggaatactttctcgcttactctataaaggcagcattactctaataccataccagacagacctttggaaatgtaagaaaagaaaatgtaagaaagtgccaatatctgtcatgagcacagctgctaaggtcctcagtaaaatactagaaaatttcatccagcaatgtataaaaagaatcatacaccacagaaaatggatttatcccaggtactcaaggcttgcttaacatttgcaaaccaatcagtgtattccatcacaatcaacaggccaaagaaataaaaatcacatgaacatatcaatagatacagaaaacacatttgacaaggtccaacacaaatttataatgaaaatctctcagtaaactagaatagataaagaatttcttcaactttataaagaatatctacaaaaaaaaactacagctaacaacacttaatggtgagaaacccaaagcttttccgaaaatattgaaaataaggaaacaaggcaaggatgtatgctcttactactgcttttcaatattttactagaagtctttgctcatgtaataaggcaaaaaaaaagaaaaaaagaaaaaaagaaaatgtgtacagattgggaaagaagaaataaaactgcctttgcagataatatgattgtctatgtagaaaatccaaaaaaaatggacaaaaaaaattcctggaactaataagcaattacaacaatattgcagaatacatggttaatatgcaaaagtcaatgaacaagtggaatataaactttaaaacaataacatttacattagcatcctcaagaaagaaatacttaggcgtaagtctaacaatttatatacaagatcaatatgaggaaaactacaaaactttgataaatgaagttaaagaataaataaatacatacatcaataaataattagggaaatattccattttcataaatagccccaatattgtcaagatgccagcttatctcaacttgacctatagatttaatataatcccaatctaaatcccaagtagtttggatatatctataaactgattctaaaggttatatggagagagaaaagagccagaatagttaacagattattgaaggagaagaacaaggttggacaggcactagtcgactacaacctactataaatctgcagtaatcaatacagtgtgatattggtgaaggagtagtcaactagatcagtggaacagaacagagagaccagaaataggttcacataaatatagtcaagtaatctttgacaaaggaaacaggcaatacgatgaagaaaatatagtcttttcaataaatggtgctggaacaactgatcatccatgtgcaaacaaataaataaataaatcatgacacaggccatacacacttcacaaaaattaactcagtgtggattatagacatgaatgtaaactgcaaaattataaaactcctacatataacatagaaaacaatctagatgatcctgggtttggtaatgactttttaggtgtaacactaagggtgcaatacatgaaaaaaagaattgatgaagtgtccctttgagaaagatgttgttttttagtgtgcttcagccatttgaaaatagcaagatagtgcatacagatcaactctgtgagctttagttaaagaagaaaaatgagaatccactggaataatgaaagacacttcagatcccagggagaagaacgttggcaaacagcccccttgatgttgtccagctgataaaaatgagtgaaaccccagtatatgagagaggtagagagcctccccctggctcacctttccactggggagctgagcaacccaggccaagggaggccacattatttctctgaagccctggagctaacttgaggagaggcttagagatgctgtgagggaaagacactgaggaaagcttcagacattttcccaaacccaggactgagaacaagataccatttttaatccaggagcatacatggtcagctattcttaggtgatctggcagcatggtcatgcaggcatttaagtttccggccagatactggaacatttgctctggagtagggtagggacttccacaaccagaactgtggaaagtttgtcagcagtaggcactggaattatgctttctctcgtctcaaccttggggtaggaaaagagctgccacagctgcaatatctcttgggcagcaagacttacagccagggccagcttggtgaccagaaactggtctctgtgtgtgtcatttctggatgccccagactgctctcctgagatcatggtgtagtgaagccctcactgctccatgcccaggcagattgccaggcattcggagcacccactcacctggttcagcaacctgagccccccacccatagtgtgcacctttcctctgctacatgcccaaacacatctccaggtatctggagcatccacttttctggattaggagtttaagctgactctcacccctgtgcagagaacttgaggccaaggagttttatcagctccacacctaggcacacctctgggtacttggtggccgcccactggattctccctcagtgttggtgcttttgtgtgccgtttgggaatgtgcaggtagggcctgcctggtctggcaccacccatctggccactagcccccagggatgagcagggagctcaaaccactgtgcattccatgaatcagttcattgtctgaggtgccagagagcttctgcaagtaaaaaaggatcaagtatatgcccagcctcattggccacagcctgctcttacctacgagtaccatctactggcttgtaggttgagctacacggtgcaacataaaacctaattaaagaactgcacggggctagagaagcaaaagccaaaagcattctttagcatcatacctctaggaaggctgggaaaaagaaagagaataaaataataaattattgttatatagaaaaaaataaaaagtaaaaattctacccacacaaaaataattacaaaaaattgtaagtgccggtgtcttcaaataagaagaaggagaacaaaaattgtgacgccataaaaaatctgaatgtagtgataccaccaaaggattgcattagctcttcagcaatgctccctaactaaaatagaaactcagaaatgacagaaaaagaattcaaagcatggattgcaaaggatctcaacaagatccaagacaaggttgaaaattaacacaaagaaacttcttaaacaatccaggaaataaaaaagataaatatctttaaaaaaaaaacagagctgctggaattgaaaaaaaaatcacttaaatttcaaaatataattgaaagctttatcaataagttggaccaagcagcagaaaaaagttcagagcttaagaccagtctttctaactaacccagtcagacaaaaataaagaaaaagtaatttttaataaagtctttgagaaatatgggattatgtaatgcaacaaaacctatgaattattggcatgtctgagagggaaggagaaaaagcaaataacctggaaaacatatttgagggaataatccaagaaaatacctctaatcttgctagagaggtcgatatcctgatatgagaaatccaaggaacacctgcaagatactacatgaaacaaacatcaccaaggcatatagtcaccagactatccaaagtcaatgcaaaagaaaaaatcttaaagacagttacagaaaaaactctgatcacatacaaagacaatgtcttaaggctaagaggggacttcttagcggaaaccttacaagtcaggagagattacaggcctattttcagcatccttgaagaaaataaattccaaccaagaatttcatatgctgccaaaccaagctttacaagcaaaggaagaataaaatactttccagacaagcaagcactaagggaatttgttaccactggaccagccttacaagagattcttaagggagttctaaacatgggaacaaaataataatacttgctaccacaaaacacacagcacatagctcacagaccctataagtcaaccacacaatataaactacaaagcaaccaattaacaacttcacaataaaatcaaaacttcacatatcactcttaacctcaaatatggatggcctaaatgccctacctaaaaagcacagagcagcaagttggattttaaataagacccataagccttctgttttcaacagacccacatcacatgtaatgacaccaatagtttcaaagtaaagggctgaagaaagaccaaataagcaaatggaaaacaaacaaacaaaaaagatcagggagcgctattcttatatcagataaaacagactttaaaccaacaacagtaaaatagggaaaacaagggcattacatcatgataaaggattcaattcaacaagaggagtttaacaatcctgcccccagtattgcagcacccagaattatgaaacaggtacttctagacacataaaaggacttagaaagccacacaattgtagtaggggacctcaacaccccactgtcagcattagacatatcatcaaggcagaaaactaacaaagaaattctgaacttaaactaaacacttgatcaattggacctaataaacatctacagaagattctactcaccaatcacagaatatatgatacattcttttcacttgcacatgaaacatacccttttttcaccactgagtatgatgttagctattggcttgtcatataaggcctttattatgttgagatacattccatctatacttaatttgttaagagtttttattataaaaggatgttgagttttgtcaaatgtcttgtctgcatccattgagataatcatatgatttttatcctccatctgtttatatgttgtatctacctttttgatttgcatattttgaatcatacttgcatcccagggaaaaattacacttgatcatggtgtatgatccttttaacacactattaaatttgttttgctagtattttgttaaggatttttcacccacatttatcagagatattggcttgtaatttttttttcttgtagtatcctcttctggctttggtgtcagaccaatgctcattgtaaaatgggtttgaaattattttttactcttcaattttttaaaaagagtttgagaagaattgttattaattttacttaagtgtttgatagagttaccagcaaagccattggatcctgagatttttgtgtcattttggggagtttttctattactgattcaatctccttacctgttattgggctatttaggttttctatttctatgtgtttatccttttctttacagtcatcaattttttggtgtataaatgctcatagaggccagttttgattctttgtatttatctggaatcaatcgtaaagtctcctctttcattttgaatcaaaattcacaaatatgtaaaaattaaacaataaactttggaacaaccactaggtcaaagaagaagtaaaagaaaattaggaaatatattaagacaaaccaaaataaaaaccgcataccccaaacttatgggatgtggcaaaaggcatacaaagcagggcattcatagcattaaacatctacattaaaaaaaaaaaaagatccccaaaaaactctaaatttccaccttaaggaactagaaagacaagaataatttaatccgaaatttagccaaaggaaggaaataacaaaggctagatgagccaaatatatagaaaaattttttaaatagaaaaaaagtaataaaatgaagcattgtttttgaaaagataaagaatatttaaaaactcttagttaaactaagaaaaaagtgagagagatctaaaataaataaagccagaaatagagaagaaggcaatatatcagctgttgatgataaaaaaattataagggactattatgaataattgtacacaaataaattagatatcagaataaatggataacttgaaagacacaacgtgctaagactgaatcacgaaaaattggaaactctgaatatatcaataacaaataaggagacttaatgaataataaaaaatcttacatcaaagaaaggcctaggaccaattagcttcactggtgaattctaccaaacacttaataatgaacacctgtacttctcaaatgaaatacttccaaactgactttatgaggccagcatcaccccaataccaaagctacacaaagctaccacaaggaaagagaactataggccaatatctttgatgaacttaggtgccaaatcctcaataaaatactagcaatttgaattcatcagtatattaaaaggatcatacaccctgacaaagtgtgaattctccctgagattcagggatggttcaacagatgcaaatcaatcaacatttacaccacattaacagaataaaagataaaatttgcatgatcatcttcaaagatacagaaaatgacatctgacaaaattcaagagtatttcctgataaaaagtctcaacataataaaagtcatgtatgataagctcacagttaacattcttggtgatagcaaattgaaacttttttctctaagatcaggaacaaggcaaggaggtccaccgtcatcactactattcaacatagtactggaagtcctagccagagcaataagataaaaagaaatgaaggccattcaaactggaaagcaaaaagtcaaattaacgctttttcttcagaagacataactatatgatctacagatatatgtgaaaaatcctaacaatcccacgaaagtgttaaaactaagaagtgaatttctcaccgactcaaggggactaagcacaatttctgaacaaatataagttatttaaaagcaacgctgaatatgtagaaagagatggaaattatatcaaacaaccaaatggaaatttctgaagtgaaaagtataattatcaaaatgaaacatttcacagagaggataataaaaagatttgaactggcagaagaaagaataagcaaatttaaggcagattattaagaaagatagaatctgaagaagagaaagaaagaaaagaaaaattaaaggtgcctctgggaaatacgtgacccactctgaaccagttgttaaatctttccttccttttaaagcaattgacaacaaacagctcggactattcctgctattcaagtgtcatttattttctccaggactcccatattagggatgttagacttcttatactgttcagacacctcatccctaagttttaagtttgtcttctgtgtgcttcagtgtaggaatcttgcccttgacctattttccagttaagcaattctgtaatctgaactgtccaatctactgttaaatgcatctactgaattcttaaatcatatttagttctgaaatatccgtttgaaaatttccagcttacgcaggatattttacattgtttgatatactgtgtgcatttttccttctaatttaaagcatggtaattatagtcattttaaaaatattctcccctatgtatgtgctcccctgtctggatcatcttgacactacttagagtgtctccttctgcttctttcttttccttttttcattctctgataagaggtcatacttgttttactcataacctacatagaaatgagttactttgtcaggtaactgattacaaagcaagcacagatgctccgggtacctccattgaagatgttcccctcttttttctgttagactggggagccaattaattccctgagtcagtcatgaattgagctaggtctgaagtaagtgagttttccatgtatcttggactaattctctctctctcatgttgctgaggtctgggcctgctagactttcacttgggtatctgtgtggctctatttcctcagctctgaaacaatataaggattcatctctattacacaaaggttcacagcccagctctccagtctcttgctacaagcaagccccaaattaggtaagtgtcttaacagacagacaatccctgtttaactatgcttcgtgtccaaaatatcacatcagtttaggaaactgtatcctttgataacattgaggctagcttatcaacatcccacaaagccttaacattcatcatatgtgacctggggagaaatgattcagaattgaaggctccagaacatctgatctgtgaatctagtcctgagtagcaatgaagagggttggtggtttccctttctctcagcacacggtctctaactaggtcaaacgtaatcctcaattcacatccagcatctgtaagtgctcccaaaaaaatgaatgactgcaatattcaactcatttcagaactgttttccatgcctaaagttttagttcattaagtacttcttgcttgcacaacttctgatgcccttaaaatatggtttttggccgggcgcggtggctcacgcctgtaatcccagcacgttgggaggccgaggccggcggatcacgaggtcaggagatcgagaccatcccggctaaaacggtgaaaccccatctctactaaaaatacaaaaaattagccgggcgtggtggcgggcgcctgtagtcccagctactcgggaggctgaggcaggagaatggcgtgaacccgggaggcggagcttgccgtgagccgagatcgcgcccctgcagtccagcctgggcgacagagcgagactccgtctcaagaaaaaaaaaaaaaaatatggtttttgaagtttaattgggatttctggtgttttcccagagaaaacatggctttctaagacttattctatcctacatagaattcgttcttctttatcctattttattaccaaaattacagaggggttgattggcaagtgctattctctttatcagattttgaaaacagtgtttctaagtttcagtcttttccccaagatgggaaaaggcaatgaggagaaaattccaacgcttccgatgtctgcttccttcccgtgttttccaccgtagcaaggtaaggactgcgtcacttagacttcaatcacaaaatgagaaaccacaccctgggctaaccatgagtcactaacaggaagatgtagcgatcactactaggactggagatcaaagggaaaggagtggggttaatggaacccgcaagcttggaatagatcccctggttccaggacttcaacctcttaggagagggtagagccaacctaccgctgaaacctctggaattcgtagaggatccaaagaccctctgaggcgactaagacctctgaaggtaagatggatgtttgatggctgtgctggtatccctggggctgacaatgctattggacctgggagttatggaatatatgtaggcaaaacgtgcaggcacaaagctactgctgctgccaaggcggaagctgtgtgttactcaggtaacattgacataaacagctatcagacacttctgtcaggtttccggtctctctagttcccccaacggcaaatactaacagagaggatgggcaaagaggaaatggagtgtgtaggttcccgttctccctgtgacaaagcgcaaggataaagagtaaaaaggggaaggaggcttggaattgaaagacagcgaattaaaacacacagaacccattcgtgagctgtgtctttgctcaagaaacccaagtctaattttataacaaataaaacactaaaattgctttaaaataatgaaaaagcaggaataagctggcattaccttattcaatagccaacatttatgattctaaactataaaagaccttggggatttctgtcagtggtctcaggcatatgcaataaaatttctcctgacagcacacacaaaattaatacgtgagaaatttcatgaatgattaagcttcttttctgaagttttaatttgttttcaagttttttgtaggtgaagtttgaacattttgcttttctttcttaggtgacatttgaacatgttgctttactttttcaggtaaagtttgagcatttggctcttctttgtttttctgtgcgtgatcaacaacaacataaacagaaagcaaagcaaaagcaaaaagggaatccataaatatggtgttacaccccttgcttgcacacctcattttctccctttttcctgggggtggtggtgccactatcaacactaccctcagtgccttctctcaggcagtcaggaggcttccactctcggcagcaatggcagtgatgtttattgttgcagacaggtctcatattacaggtcacgggcaaacaggtactgttcaaaagtgacatagtgacacatttcctgtgcatacagacgtgttctgaaccacactcggtagcatctttcacgtcaccaatatcaggagtgcttatccccattcgatagccggtatcccagcaggtgacaccaatgaagtgagtccggtgcagagtagaatgatctctcaaaagggggatttcttgcatgttctcacactcaactctcccacacaagatatctgtgacctcacatcttacctatttggtgccattgaaaccacagtgaccaaaatgatcacctcggatgttcatattactgcagcaactctgatttgcactgttggctacctggccaaaaatttgtctacactgttcatcacagttattacatctcttttcgtagcagtggccactgcccttgcaggggatcccgtcctgcaaacacacatcttctgcacactcatgcgaagtcccgttgaaccactctggaagatcccattcgctggactcttgtctgcacacttcgaccgatggcatgatctggcagtttttgcagcaaagccccaaaacacaagcagccccaggtttgaaagtgcaatttgcaaagcaacatggctcttttcacacgatggtaagtttccgcggtcatactcttcttctaccgcaccattcccacagcacctctgtgtcatgattctatctcgatttggtgaagcatgcatgcagatcgttgttacagtggtttgaaaaaatctagcattaactacagttgctgaatctttttgtggaagttgccgttggaaacattatacacttttttgcccacaggaacatgtttttgtatcatgagtcatacccaaattatgaccaagctcaggtgctgctacgagtgcaaaagatcccactctgttatgtccaaaactgttaattgcataattactttctctataacatactgttccaacattggctaagccaagagtaataccataggagcgttttacaataagatgtgcaacatcatgaggaatgcaagaattaaagctagtttgtttccatttgcaaatttctttcaggccaacacctgcagtgtccattgtaatgaagttttcttgagtccagatctcaagtcccactacagtgacaattggcacccagtggaatataaaatgcatcagctttttgatacagcatgagtacttcctcctgcacatttgaggtatgactttccagataaaggaatcattcatcatctaccactactgccagttcaacaaacaatttatgggtccaccagccctcaaagccactttgcattagagtagaaggatcttgaaacttcaattgtcttgctatttcttcctctatcaacccacatctcatgggtgggaattgtgtctcctcattgtccatcttatatatcagatgttcaaatgtggctgaaacccttttgggcttgatttcctaagcagtgtcatttatctgtggtattccttgaaagccccccaaacagctgctaagagcaaccagggattctgggtccccttccacataactgtgatagtagcagtcatcctggacaaaagttggtcctcaaaaatagcaccctggtctgagtaggtgaacacagagaaggatttggatatcaaaaatatcaaaagcttattgaccttcatgtggacaatgtacctttggctgccaacttgcaggccataggacagccagccttgagtgtccgtgcctctgtcagcaccagttatcctcaggggtatcaccacttctgggaggctttggtgttgacagagcccaatctggagccatccagaaaagaacagaaacactcccagccagagcagcagatggatgaacctcacatggaccagggcctcgctcactgccctcatggagccactgtgatggagctatgggtgagagcaaaggaggggaggcaggaggcacagctggtctgtctcctcctctgagttgcttttgtttgatgttgagcttaatggtctttctgctggcagagtcagtctatcagagcagcacagctaaaagataaagtgaaaagaatggcagagatggggtggtgtgagcagaacagagtggaaaagagagagctgggtgtgggtaaaatggagtcatatttggctcaggacgtaactcattatactgcattggatttgcttctgcatattggcaaggcagagtgagactgtgggtgtaaaaaagaatgacagttggctgcaggttgataattactgaacctagatgaaggacacatgggttcattacactgttgtctaaatacacgtatgtgtgtgaacatttctgcaacaaatacctaaaacagaagagtcttaatggaaaggggaacgtatatctcattttgatgagagaaccttgatttatgcatatagacttggaataagtgtagatatttcttatcaatttcaaatgataaattattcagtcaccttactcagaagagagacataaaaatattcacacatcttactttcttatcatggtcctcaatatatacttctctgcaaaatattacttgtcctatcttcatctaatactgtcaaactgcgtagtgtcaaaatatcaattatccttcaaaaacgttagcgtctattttaatggatcccaaattcaatataataataaaccattgtggaattaaaagaggatataccttgggttgacagacgttcccgaaagatgatcatatttgcttatactcttatgaaaagtaacatttgtcaaagcctctaacaaaataaaatggaaaggaaatcaaactagctggaaaagcaacagttggaagtgggaagacatggaagggaaagcaaagtaccttcagaaataaatagaaaatcaatgagctccaaaaccaggaaggaaagctttggaggaaggtaggatttttgtccttgagcaaagatatcaaaatccatggcatttttagggttataaggtgaccactcctgagatccacccttgaaggtatttatgggataaataaaaatacctattccatcaaaaaaataaaatacaaaaaaggtctcaataatacaaatgtatcatcagatatttatgaaaatgagagatctggtactagcacggtgcctggctgccaatactgatttattgctgttcttgaataaaatattaataaaaccacctgatatacagacattatgctgcaaattttagaatataaatgaatgatactggcctaaataatttagtagtctggagcaaacatttagggagaatgtttggggcaaaaacacactttaggaatctgcataattacattcaatattttacatgtaaaatgcctaatgttgtttagctagtgagagtaaccacagtctttatcagacaagtaaagtaatgagattaagaattattagtcaagttgagaaaaaaaaagacctgaggaaattgaaatctgctttgagtgacctaaaacagagtgatcaaattccacttttcatagtaggtattataaaaacaaaagacgccagattcagcacctaacatctcttggacttggacccatttttctttaaaatttccttaatttttcttttatcttgattctaagtgtttgatctctctgcaatcattttcttgtcactcatggaatcttcctttcatgaaaagcaacaagaatcttttctctattcacaaggttttatggtgagcttcttattcatactaggttttacaaaaatgtatatctcaacaatgtgaatcccagcagaaaggaggctttgtcatatgccctgcagaacatatgtagagatatggttttgccatgttggccaggctggtctcaaactcctgagctgaagtgttctgcccaccccagcctcccagagtactgggattacaggaatgagccactgagcctggcccaataatagttttgagtaaaaatattgcattaatgtttaagctatagttatctagaaaatattaagttttatattgcttataattagtaagtttcccattaatccttttgcttcttactttaccatctagaaaccaaggctactaatactatgaggaacttgttgggaattggagaaaaggtgactttcattatgctttagcaaagagactggcagcattttgccttttctcttcagatctatggaacattgaacttgagagaaatgatttagagtatctggtggaagaaatttctaagcagcaaagcattcaagatatgatgtgggtgctgttaaagacattcggttttatgtattcacaaagatatggtttggaattggaacttatgtttaaaagagaagcagagcatgaaagtttgaaaaatttgcagtctgacaatgcaatagaaaagaaaaactcattttctgaggagaaattcaagctggctgtagaaatttgcataagtaatgaggacccaaatgttaattgccaagacaatggggaaaatgtctccaggacatgtcagaggtcttcatggcagcccctcccatcacaggcctagaggcctaggagggaaaaatggtttcatgggccaagcccagggccttgctgctttgtgcagtctcgggacatggcaccctgtatcccagccatggctaaaagggcccaatgtacagctcaagccattgcttcagagggttcaagctccaagccttggcagcttatatgtgtgttgggcatgcaggtgtacagaagtcaagaattaagatttggaaacctctgcctagatttcagaggatgcatggaaatgcctggatgtccaagcagagttgtgcttcaggggaggagccctcatgaagaacctctgatagggaaatgcagaagggaaatgtggggtcagagcccccacacagagtccccaggagggcactgcctagtagagctgtgaaaagagggccaccatcctccagaccacagaatgatagatccactgacagcttgcaccatgtgcctggaaaagctgcagacactcaataccagcctgtgaaagcagctgggtgggggtggggatgggggtgctgtaccctacaaacccacaggggcagagctgcccaagaccataggaactgacctctagcatcaatgtgacctggatgtgagacataaagtaaaaggagatcattttatgtcttgactgtcctgacagatttcggacttgcatggggcctacagcccccttcattttggccagtttctcccatttggaatgagtgtatttaccctgtgcctgtacccccattgtatctaggaagtaactagctctttcttactagacataaaattaactgagacagttttaatttcattttgatttttttctttagcaaagggaaggttcaaggcccccccaaatcagtatcaagcagaagcattttttcaacaaaacgcttttcataatcagatacaatccacattgattccctcagagatatactacagaggttctctttcttgaaatgtttatatgttaaagtagaactggagactcccttgtctctggatgggtaaacaaaaagaagatgaccacgggcaaagttactgagcacaggttacttactgttatgtaacaaattaatctagtggcttaaaaattcattttataatttattattatttattatattatttatgtgtagggcaggaattcaggcagggtatggctggacaattttcgctccacgtgatgtcaatcagtgttcatctggtggcagacagctggtggtttgactggtcttgagggtctgaggtacatttactcattgtctattccttgacagagatggcccagaaggctgagcttggtacagtctgttccttagagagcctacataatacctctgctgcatgaatttcttcttacactacagtgctccaagaacaatcattccaggaggtacaggcagaaactaacaaggcttcttaggatttagcttcagaagtctcagtacataacttgccacattacattagtcaagcaaaaagtaaggctaggtgagattcaagtgaatttggaaggttttaaaaggaggaagagattccatttcacatttaaaaaaatggcatgtgtcttcagcaaaggaatatatagctgaaacacatcacaggcacaaggtacttcagtttatactctagctccacaatttaatttgggtgattatttttaatagactattttttagagcaattttaggttccaagcaaaactgagtggaaggtacagagatatctcaaatggctcctacccctatgtaagcatggcttccctcattattatcaaccctctccaaagtggtacatttgttacaactgatgaacttatattgacacatcattgtcacctgaaatccatagttaacattaggttttacttttagtgttatactctctatgggtttgacaaatggataatgacatgtattccacatagtatcatacagagcactttcactgccctcataatcttggcacttagacttttcatccctcctttcccctaagccctaagaaaaaccatatcttttaacactcttcatagttttgccattttcagatgtcatattgttgcaataacatggtatgtagtcttttcaaattgggtttcttcacttagcaataggcgtttaagtttcctccatgtcttttcatggctcgctagtgcatttctttaagtgctgaataatattttattgcctggctatatcccaacttatttatccattcatgtacttaagggcattttggttgcttccaagttttgacaattatgaagaaaatgatataaacatccacatgcaggttttgtttgaacataagttttaaattcttttgtgtaaattcctaaggactgcaattgttgaccatatggaggggtgtgtttattttatttatttatttatttatttgagatggcgtcttgctgtcacccagactggagtgcagtggtgcgatctcagctcactgcaagctctgcctcccgggttcacgccattttcctgcctcagcctcctcagtagctgggaccacaggcacctgccaccactcgcggctaatttttttgtttttagtagagacggggtttcagtgtgttagccaggatggtctcaatctcctgacctcatgatccacccgcctcgtcctcccaaagtgctgggattacaggcgtgagccactgcgcctggccggggtgtgtttatttttaagaatacaaggtatattacaaagtagctgaactattatgaattcccacaagcaatgaatgagagttcttgtggctcatcatcctcgccagcatttgatgtcattagtattttggattttggctcttccaatgtgtgtatagtggtattttgttgttttaatttgtacggtcctgatgatggattatgtggagcatcttttcatatgcttatttgccatctgcataacttcttcagatgtctgttagtctttgatccaattttttaaatcagttgtttccttactgctcatttttaagagctctttctctattttgaataattatttatcagaaaagtattttaaaaatgtttttctcccagtctgtatctttacttttcattcccttgacagtgtcttttttctttctttctttcttttatttttcaacttttattttagattcaggggatacatgtgtaggtttgttatatgggtatattgcatgatgctgaggtttggagtataaatgatcccatcacccaggtagtgagcacagtaccaaatagatttttaacccatgcccttttctcccttccctctccaatagtcctcagtttctgctgttgccatctttatgtccatgagtacctaatgtttagctctcacttatgagtatgaacatatggtattggtgttctgtttctgtgctaattcacttagggtaatggcctacagctgcatccatgttgctgcacgtagacatgtttctattctttcttatggctgtgtagtattccatggtgtatatgtaccacatttgctttatcccatctgtcaccgatgggctcctaggttgattccatgtctttgctattgtgaatcgtgctgtgatgaacaggcaagtgcatgtgtctttttggtgaaatgatttgttttcttttggatgtatatctagtaatgggactactgagtcaaatggtagttctgttttaagttctttgaaaaatcttcaaactgctttccacagtggctgaactcatttgcattcccaccaacagcgtataagtgttcccttttctctgcagcctcaccagcatctgttgttttctttgactttttaataatagccattctgactggtgtgaaatggtatctcattgtggtttggatttgcatatttctgacaattagtaatgttcagcattttttcatatgtttgttgccttaccgtgtgtctttagaagtgtctgtttatgtcctttgcccactttttaatggggttgttttttgcttgttgatgtaagtttcctatagattctggatattagacctttgttggatacatagtttgtgaacattttctcccattttgtagggtgtctgtttactctgatgatttattttgctgcacagaagctctttagtttaattaggtcccacctgtcaatttttgtttttattgtgattgcttttggagtcttagccataaattatttgccaaggccggtgtctagagtggtaattcctaggtttccttctaggattcttatagttttgagttttgcatttaaatctttaattcatcttgggttaatttttctatatggtaaaatggagtgatccagttttaatcttctgcatatggctagtcacctatctcagtgttatttattgaatagggagtcctttccccattgcttatttttgttgacttttgttgaagaccagatggctgtaggtgtgcagctttatttctgagttctctattctggtccattggtctatgcatctatttatgtaccagtaccatgctgttttggctactacagccttatagtacagtttgaggtcagttaatgtgatgcttctggctttgttctttttgcttaggattgcagtgtctattcaggctgctgcttttttggttatacataaattttagaatggtttttcctacttctgtgaaaaatggcattggtgattttataggaatagtgttgaatctgtagattgctttgggcagtatggccattttaacaatgttgattcttcctatatatgagcatggaaagtttttttatttgtttgtgtcatctatgatatttttcaacaatgtttggtagttctccttatagagatctttcaccttcttggtttggtgtgttcttaggtattttatttttgtgtggctattgtaaatgggattgttttcttgtattgtaaatggaaatgttattggtttatagaaatgctactgatttttgtacattaatttgtatcctaaaactttactgaagtcatttatcagttccaggagccttttggcagagtctaggattttctagatatagaagtatataatcagcaaagagagatcatttgactcttttttctatttggattccttttatttatttttcttttataattgctctggctagcacttccaatactatgttgagtaggagtggttagcatgagcatccttgtcttgttacagctctcaaaggtggggatggttccagttttgtccattcagtataatgtgggctgtggttttgccattgatggttcttattattttgagatatgtttcttcactgcctagtttcttgagcatttttttataaagggatgttggattttatggaaagatttttctgcatctattgaaatatcatatggtttttgtttttaattttgcttatgtggtgaatcacatttattcatttatgtatgttgaaccaaccttgcatttcaggaatgaaactatctgtattgcagtgaattaactttttggtgtgctattggatttagtttgcaagtattttgttgaggatttttgcatatctatgttcatcaggaattttggcctgtagttttcttttttcattgtatctttgccaggaatttgtatcagggtgatgctggctttgtaaaatgaatcagggaggagtctcttctcaatttatttgaatagtttcaaataaatagcttttttttttttgtatatctggtagacttcaaatgttaatccttctagtccatggatttttttttttggttggtaggttttttattattggttcaatattataactcaatattggtctgttcagtgttcaatttcttcctgattcaatcttgggaaattgagtatttctaggaatttaacaattttgtctagattgtctagtttatgtgcatagagctgttcacaatactgcctgagtatcttttgtatttctgtgaaaacggtgggaaagtcatctttgttgtttctgcttctgcttatgtgaatcttcctttctttcattctttctttctttctttctttctttgttaatctagctagtagtctattgatcttgtttatcctttcaaataaccaacttttggttttgttgatactttgtatgggttttttgtacctcaattttgttcagttctgctctgatttacttcttttcttctgctagctttgaggttagtttgtttttgtttttctagttcctctaagtgttatgttcgatcatgaattttagacctttctgtgtttttgaggtaggtgagtagtgctataaattttcctcctaacactgcttttgctgcatcccagatattttagcacagtgtgtctctattttcatttatttcaaataatatttttaatttctgctttaattttgttgtttccccaaaagtcattctgaagcaaattgtttaatttccgtgtaattgtgtggttttgagagatcttgctcatattgatttctttttttattccactgcagtctgtgagtatggttggtataattttaacatccttgaatccattgagacttgctttagggttgagcatctgttcaatcttggagtatgttcccaagatgaattattcgtagagctataatatatagcataggtaatatcgttaataataatgtattgcatactaggaatttgctatgggaatagaagttatgttctcactacatcagaaaaaggagtatgtcaggtgatgaatatattaatttgcttaattgtaagaatcattacataaagtatatttatatcaaaataccatgttatacttcttaaatatatacaatttctacatgtcaattatatctcaataagactgggaaaataaaagtaaaagtataatattctaaatgtagccataaatctctcaattaccaaaaatgaacttgaaagctctatctacctcaataggcggagagtttctgctttaagactcatttttcaaaatcttgtgctaaaagaggccatttatttactcctgtacattttccatagtcttctattcttccccattttcttctttcttgagtgtataatgtacttccgactactgggaaaactgtctcaaatactactgattgaactataattggctttttaaaagccacatggagaaaaaactactaagatagtcatcaattttgcagaaaatacaaccacctcttattttccaagctgtgtctacacattggcagagacaggctacgagaactttttcttcaaatttgcattgtgggttcatcattactggcaaaaataatttttcacagattctttataagttaaacataagcttaaataatgctcttcaaaccttggccctaatgcacatccttttattttataaaatataactagccccatttagagttagaaggaaaaaggcagagcagtaattgagattatttcaatttgctataataagttgagattatttgtaataattgagattatttcaatttgctatatatcttccaagtcttcaggttccaaaactgtattgctacagaagcatcagaaaactctcagctttaactcaactcccatttaacttataaaacatatctgaaaaagtaattctttttccatttgatgcatgtcttttatgatttttttggttagaaacataaaatttagaaactcatttttgcttcaaggcaaaagtatatgcccactgaaaacatcctaggaacaagttgtttttcactgaagccactcgaatgaaaacatcacaaaccaaaatgtttgtcagggatccattgagtgttagaaacagtagagaagagacataccaaacctgggagcaggttcctggaagcttatcatgtagttaagatgagaagttatgtaacaataacaacaaaacaacttttatataatatcacgcttcaatataatataacataatatagtatataaatgaattatatgatgacaaccatgtgtcaggcacctgcctaagcactttacctatattaactcatttaatacttacagtggccttacaggatgcttataattactatgattattcacattttacagataagaaaaaagacaaagagcaaagcaattttagagttagatcattaacccagcccatgtatctcccatgtccgttttcttatttgctagatgctgctgcttctcttattatatcatgtcttacaagggcagaggcaccaaatgggtgcaacagaactgcagagaatggaaggaagtcattgtggcttgaagaatttgaagaataaaagaggcatggggctaggtcttatgtgaacaggaaaaagctactttaagctcataagtgcaggcaaaaaacctagagatcatctttgtccttccctttcattaccacttcccacacattccatcacacaattatctccttctttcttctaactggctttctcattattctacttctcttcattgctactgtcattatagctttctgtcatggattttgcttgaactaatgctatagtctcctgactcacccccctgcccttgatattttttcaattcattctccacattgtagttagagtaatgtttctacaaaacaaatctgattgtattattctcttgctcaaaattattcattagctcccaattttccttaggaaaaaatatgagttccttagcatggcttagaatgcccttcatggactaaccattgcataattctgtaatctcagcctcagagcaaaccctctcaccatcaccactaccaccaccacagctcgtggcagcatacctttttccactaatgaatttctttgaattcgtcaaatatctttcttgtttccttgagtttttcaaataatatctttcctgagtatctccttcttccctattacatattatttaccattcaagtcctggcatcaacatttcttcatttggaaagtcatccataacccccaaaatgatgctaattgtttgaatgtgatccctattcttatattcttatttttatgggcagtcctcagcatactttaagataattaccggttatttgttcagttatctctaagactagaagtctgcgaggttagagacccctcttttattattcatgattttatctccggtactcagggtaccaaatccctgtctcctaagcatgcatacaaagagatgccatgcacttcaaaagtaaacacggcagggtgtggtggctcatgcctataatcccagaaccttgagaggccaaggcaggtggattgcttgagctcaggagtttgagaccagcctgagcaacatggtaaaaccccgtctctaccaaaaatacaaaaaaactagccagacatggtggtgtgtgcctgtagtcccagctactgaggaggctgatgtgggaggatcactagagcccaggaggtggaggatgcagtgagccaagactgggtgacacccagcctaggcgacagggtgagaccccatctcaaaaaagaaaaaaaaaaggtaaagatagggaaacttgaaattattgcagtgtaaattacccaagctaaagcacagaggaagaaaagactaaataaatacatccataacagagccttgggcagtgagtacaacatctagtggattaacatatctaaaactagaataattgaagacagacggcttaaaataatggcttaaaatgtttacatttggtgaaaattataaatccactatttcaggaaatttaacaactccctggtgagttttattttgctttaaccaaataaaaaccacagcaaggcatatcataatataaatcattggtaaaaatttgtattcgctggatctttataaacatccagagaataataagtacatttatatttcagggaacaacaatagcaatcatctccgacttcacatcaaaagtaatgagacaaaagacaatggaaagatagcttagaagtcttgacagaaagaaatactgtgaagctagaattatataactagacagtttttaagaaatgaattcaaataaaatatcttccaggcaaacaaaagcagagagaatttattgtcagcaaatatgcactatgagaaatgttaaagaaaattcttcagagggaagggaaataatgtcagatgaaacttatatctgtaaaatgaaggatttcagaaatagagaatgtgtaggtaaataccaagtgtatatttcgattaattttgttacaagataaatggtcgcttaaagcaaaaataataatgaactgagggattagtaacatatatgaaagtaaaatagttgtattagggtcctccagagaaacagaactaatagagaaagaaacatagaaagagagagagaaagactgactgtaagaaggctgggcgtggtggctcatgcttgtaatcccagcactttgggaggctgaggtgggtggatcacgaggtcaggagttcgagaccagcctgaccaacaggtgaaaactaccaaaattagctgggtgtggtggtgcgtgcctgtaatcccagctactcaggaggctgaggcaggagaatcgcttgaacctgggaggcggagattgcagtgagccgagattgcactgctgcactccagtctgagcgacagagggagactctgtctcaaaaaaaaaataataaaaaaaaataataaattgattgtaagaaattggcttatgcaattgctagcagtcttcataaccaggaagagcagatgttcccgttcaaaggcagtcaggcagaagaatttttttttcatctggggagaggtcagcctttcgttctagtcacaccttcaactgattggatgaggctcacccagtattggtaagggcagtgtgctttacctagtctaccaatgtaaatgttaatctcatccagaaacacccttgcagatacacccaaaagaatgtttgacaaaatatctgggcaccacctgccctagtcaagttgacacataaaactagacatcacaagtttaccccttgtcaacttggcatctataacatctccttaaattgtacttaaactccaagtaaagacaataacaaggccataatttcacctagtctgatataactaccctgtgtgaaaccaaaaatgcactaattccttccccagaaaaggaggtaaagtccttgcatgatatttacttttctttttgaactcccatagcttaattactataatgtaaagttaacaatacttaagtactacgatataaagtcaacatatcttatgttacacaataaggatataatagaggaaaaataagatattattatatgcacataaacaaatatattgattaaaaataaaggggaaatactcagataattacagttctcatttctgtaatgggtcgcatggtcatagctggtatttataactaagttcttgcactttgcctttagcaggtacctcagctctggttgtgattctttattaacaggtatgggagcaagcatatgacaggttaatatctgcatcctatgtaccaggggatatattaactttctcaagcaatgaagccacatctggtacaaaagctgcagttggattcatcatctggataaacataggataatccactttaattctccaagatccatcagtcttctgcacaggccacataaactcattgaatggggatgtgttgggaatcaccacctctgcatctttcacgtccttgatagtgcccctaattctctgcagtccctccgggaatgtggtattgcttttgatttactaggtagaggcaattcgagtggctttcacttggccattctcactataacatccctcacttcacaggtcagggaaccaatatgaggattctcctagatgctgaatatgtttattctaatgatgcactctagaactggggaaatatccaagttcatggacccagtgggccaactgtaaaaaagacctgaactaaaactccattgaccacctgagctcgataagcccctactctgactggtggatcacagtcacttggggtttcctggaattagcgtcacttcagagccattgtccagtagcctccaaaggtttgattacttctgtttctcttagtgtgcagctaccctggtaacagccataagtcctttgggggaaggttaggagacagattaacagcataaatgttggcaatgtaccaggggtcttctttaaggggccagtcccttattcaaggggttctgggtctataagccagctcaaatctaagaactgattgaggggctgtgactctctgtttttatgattcaagttagactttaattcacttgacctagaaggtctctgcttatgtagatcgagtatgaacttagtagggcttcctatctatttcactctgggaacattatcatcaaatagccaatgtcaccaggcgtgtgtgtcagactattctgagtgctgctgtgcctctgctgtttattatggtaaccactcccacctcgctttgggcaggttagtgctgccacttggccctgacaccctgggattcaattactccactgcattctgttatccaggtcagtgactgcagttcccaccgtaaggtctggcctacagagaaaagttatcacaggctctgcaaggatgctggggctctcctcacaagtttatttctcagaggattagtgaaaggtctgtcttctgaaccctctgaggataggtgagtaggttttaaccaacaaatggtctctaaccttccaatctccctaacatttcaatctttcctttgaatcccttctcctacatacaaccaagacaggtccagaatttccaacttgcttattgtgggccatcttttggtccatatttaagtcaacaaactggtagagccctttttatctcccagagctacagcattaactgcaggatctctgcttagtcaaccaaggtcaatgaatttgacctgatccaattttatgttccttctaccattattccacacccttaatatccattttcccacacgttccccagatttctttctgtgcaagttaaaaaacctcaagtaggtcttctgaagtgtagtaaactcttataagtcacactttgcacctcaccttgagaagcctgctgggaccggagtgaagtggcaggtctagaagcaaagaggggtggtagggtggggtcctgataagaacagcattgtgttgcacgcctcgggggaggccatgacagtttccttgagcaatacagggttaatctcctcagacacaggtgaaaaggcaactttccctggcagtgggaaggctgcttgcactggagctaggcctcttccactggccaaaaagagctaccagaatttaggggctcaatagctccagtttcatcagtttctcccacatgtccctgtttcatacttcagaattctatttcttcccaatcgcttcctcactttaacagtagacgccctgcaagtctggcagtttacctcacgttgtaactcagctggtcacaggacaagattcaggcttgattttcagcagtctcagccctgtggctagagggatgaggcctcctgagctggtcacaggacaagattcaggcttcattttcagcaatctcagccctgtggctagagggatgaggcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctgtggctagagggatgagtcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctatggctagagatgaggcctcctagagggcacacattgaagttttcaggtcatctattgaacccttgagctgggagcttatttctttcttttcccacattgtccagtgacattaggagcaaacagccaatatcattatactcattattttgacaaaaatattgaagaatattgtatacacactcaccctgcttcttataagcggttgattaggggaatctaatggtaatattttgcaaatttctactgccagatcatgctatgaactgtcaatgctctccatactactggaaatagtcattggtacctctaaatgtaagtgaggggaaaataggatctggaggtgagagacaggactagctggatttcctaggccaactaggaatccctaagcctagctgggaaggtgaccacatccacctttaaacacggggcttgcaacttagctcacacctgaccaatcagagagctcactaaaatgcgaattaggcaaaaacaggaggtaaagaaatagccaatcatctattgcctgagagcgcagcgggagggacaaggattgggatataaagccaggcattcgagctggcaaccgcaaccccctttgggtcccctccctttgtatgggagctctgttttcactctattaaatcttgcaactgcactctcttctggtccgtgtttgctatcgctcaagctgagctttcgctcgccatccaccactactgttagctgccgtcgcagacccgctgctgactcccatccctccggatccagcagggagtcagctgtgctcctgatctggcgaggcacccattgcagctcctgatcagggtaaaggcttgccattgttcctgcacggctaagtgcccgggttcgtcctaattgagctgaacactagtcactaggttccacggttctcttccgtgacccacggcttctaatagagctataacactcactgcatggcccaagattccattccttggaatccgtgaggccaagaaccccaggtcagagaacacaaggcttgccaccatcttggaagcggccagttaccatcttgggagctttgtgagcaaggaccccccacccgggtaactgaggcagggaacatgagatcgattcacacttcagctatgagagaaaatatcctctccatttacatagggcatatgctcagtaaatgactttgtaactttacttcatcctctacatttatgtagagtgtacaccaagtaaccaatggaaatctctcaagggtatttaaactccccaacattctgtaacagggcccttgagctcctatgctcgggtccattcccacactgtggtgtctacttttattttcaataaatctcttaattcctccctcgctttgcttgtgtgttttgtccagtactttgttcaagacgccaagaacctggacaccctccgccagtaacataagcgtatcagagagcagattttagaaagcctgaaatcaacccagacaactcattctcaaaattctttctccagggcaacttttggtatcaaaagctatatgagttagggttctccagagaaacagaatagatgacagacagggagatagatagatagatagatagatagatagatagatagatagatatagattacatagatagatacagattacatagatagatacattgagcaagttcattggtgccatttttcaaacattatgtgttcacttcatgtccgcatgtcagcatattttagccataaatatttttaattaaggcatatatgttgttttttagacataatgctttgcacactgaatagatgatagtatagtgaaaacataacttccgtatgcactggcatccatgcacacaatacatatgcatatttcccaatctatacatagatattagtgagcataatggagaaaagaatcatcaaagcaagaattattgacttcagatgggattgtgctaactttctctcacttctcaaaaccaagtgagaattctgagaaattcaataagggacaccttgtggagcaacaatgattaccttttgtgatgagattgtaaagataatgacacatgtataataggaaaaaaataagcattgctttctataatatcttactgctgcccaagaggcccattgttggattggcaccaatggtagctatggagaggcaaatgtagatgtggaaactgggacagggactaaactactccacataataaggattagaggaatttgaggtgtgaagggtgagaataaagggaggaatgtatgaagaagaagctaaaaatgataatttaaagctttgtaggggcaagaacagagtaaaaaacctatgctgatggttctgaaggaaagaaaatgtaatttttacttcagctctcataagttcatagttgtgacagactcctacaacaaaggacaaggtaacgagaaaaacaagcaagttctttaacacatgcagggcatcacatggaagaaaagtaactcaaagcagtagtctaggagtctggcttatacagcatgtcaacaaggagcagtaggtttcacaagtgaaaagacaaagaaaagcagttacaggcttccattggtgggaaacggtaggaaggtaaatatatggaaatacactaataaagtcaagtcggcttgagattgctctgggccatttctgggctgataagagttggaatggagaatttacatactgtctttaggggagaaaagaaggagagagtaggaaagtgttttcttctgtaaatctctatcctgcttttaggcaaacagagggaaggcagagactcccctgaatcttcattgtcttcagctcaacaatatttatgtcaaagaagcacattttgagatgacaccttctggtttccttcagtctcccctttgaaactttcctttcagaaagttttacatagaagagccaagttggtagctttggagcaatttggctaggggttgtgagataagggattggcaaaggcagagaaaaacatagattgaaacaaacagaaaagaacaaatttgagtaagttatcccatatcttattgaatcagtctctgagtcctgggaatacatatggtatttaaacaggtgtgtttcatttcaggatgtggccttgcacatgtgttcccatcaaaggcctccatatggtgcaggcaaatatatttatgaagaagcatttctatggaaataaaagaaaaacaaaagattaataattggagccatctacaaactactatctgagtctggagggcagccagctgagaagatttctagatgttcaactcaagcatctttttttttttttttttttttttccagacgaagtctcactctgctgcctacactggagtgccgtggtgcaatctcggctcactgcaacctccgcctactgggttcaagtgattctcctgcctcagcctcccgagaagctgggaccacgggcatctgccaccacgcccagctaatttttgtattttctgtagagacagagtttcgccgtgttggccaggctggtctggaactcttgacttcaggtgatccttccacctcagcctcctaaagtgctgggattacaggcatgagccaccacgcccggcctagactcaagcatctttagttgaagcaggagcaggcagtggcaagctgacaaatatttctggtttgccatttaaatgtcgtaaagcttgtctataaataagctgttgtgatttcttggaagtttgtatcaagttgtctggcttctgcttggaaaagcacagtgttagttttcataatttcaaggcagaaataatggaagaaaattttcaaatactagtttggaaagtcacagccagacatttgagaaaactaaaagaattcagaatccagtccagtttacaggtaaataataaaatctcaaaaacaatgaatatggttagaatctaattatcaggtgcataacagtttcctatttcttttttatgaaatataaattttttctctgtagtccccctatttttaccaaagataataatggtaagtccaatttatttgcaaagtaagtttggtccctcattaaatttagcttgatcacttacatagtacagcaagaatggtgattgatcatataggctttttataaatttgctttgctggatctttttataaggaatctcacattagacttttgaaaacctcttacaactaggaagctaagctaaggactcacgatcaaacgttgccagtaatgcctgtcaatgagcacgaatacatgtgttctggaggttcctcaaagtatcatgagtttcctgggcccatcatgaaccaacattgtttactcactgtaagtacagaaacgttgtaaggaaaccatgtattcaaggtaccaggccagttttttcaaggggcttttattggctccataaaatcagccttaatttcttaaaactctgtggtcatgtctgaaaatatgacattcctggcagctttggtaatgtaatcagtgtttccaattgttgcctgctgcaagaagaatatatttttattaaacttatacaaataactatattgtcatagaagtaagaatacttctaaatagttttcaaatttttaggtagggagaaaaggtaattgttttaattctgctcacaaaaatatactttaccaaatgccacaagctatagatagcttaagagaaaagttttccttaagtctggaaaataaaatataaaatgaatcagcaatgtttcaaagaaaaatctatttaaaaattataatccttcatcagttctgtgttgtgcaatcaattcttttgcttgatgttaacaattttattaactcacttttcccattagttttcaaaattcttatccactcaacggagtgttcttaaagttatcagaaacttgcttttaacagtacttatcagaatcttcacaattttctctgaaaaagaagtaattttggactgtagctgattggaaaaaaaaattagataagaatcaaagctgttggctgggtgcgggggctcaggcctgtaatcctagcactttgggaggctgtggcgggcggattgcctgagctcaggagtttcagaccagcttgggcaacatgatgaaaccctgtctctactaaaatacaaaaaaagccgggcacagtggctcacacctataatcccagcactttgggaggccaaggtgggcagatcaagaggtcagcagatcgagaccatcctggctaacatcgtgaaaccctgtctctactaaaaatacaaaaaattatctgggcggggtggcggggcctgtagtcccagctactggggaggctggggcgggagaatggggtgaacccgggaggcggagcttgcagtgaaccaagatagcgccactgcactccagcctgggcgacagagcgaaactccgtctcaaaaaaaaaaaaaaaaaaaaaaaaaaatcaaagctgctatctatggatgacaaagacttagaatgacgtctgaactctcatcaggttgttagcaatcttgtgaacccagaaaatctgagacaggtctcagttaatttagaaggtttattttgccaaggttgatgatgcgtctgtgacacagcctcaggaaatcctgaccacatgtgcccaaggtggtcggggcacagcttggtttatacattttagggagacacagcaatcaatatacggaagaagtacattggttcggagacacatcaatcaacatatggacgaagtacatgggttcggtctggaaaggcgggacaacttgaagcaaaggcaggaagactccaagcagggagggagcttcccggtttcaggtaggtgatatacaaatggttgcattcttttgagtttctgattaggctttccaaaggaggaaatcagctatgccactatctcagtgagcagaggggtgactttgaatagaatgggaggcgggtttgccctaagccatttccagcttgagttttccttattgattttgggggcccaagatactttcctttcacattccccctcttttcttttaaaaaaccttttggaaaaagcattttacaagaagatgaatctccggtctcaggtttcatctgatctctcatgactagaacggtttattcctagatggggaggtcccaaaagctcatttttagcaggttgtgaagtctcatgtcctgtgaagagaaaatagtgggaaggaagggagaaaaagcaacaacaaacaaaagaacaatcctggaaaaatcgatataggccacgttacgctgaagtccatacattagtaggcaggtgtgaaagtggcttttggatgtgaataagtttctattattttcttctgaaatttaagttgtgtggcttcagtttggagggtttaaagaaagcacagcttagttttcagtgactctgaattaggaaaaatgaaaaagaagacggaaaaaattgaaaatgttattttgaatacttgtagccaagaaaaattataattcagtccaaactgtagaaaataataaaaattaaaaaaaaaattaggcaagactagaatctaataatagatgtactatagttttgaaacatatttttttctctccagtttcccatttttaactaaaattatggtaggactggttgcctttattatacttggcctaattatttgtatatagtgcagcaagaataattatttttttacataggcctttacattggctttgatggaactttgttccataggaggaatctcagacaagacttttaaagccaagcccagccatggatttgtaccatcaaatacctatgggttgggtgaatttcctctcctctggaggttccaagataaacctggggcttctgcacctgtcagaaagtgacattctttacttcccacagatcacaagccctgtacagagactgtgtacacaaaatatgaggctagtttccaatggctttattggcttcataagtcaagtttgattccttaaaggaaagcacaccattccagtcaaagccatggtaaaataaccagtttcttcaattgtgtcccactgcaaatgaaaacagtttcttttttttgacagagtcttgctctgtcaccaggctggagtgcagtggcacaatctcagctcactgcaacctctgcctcctgggttcaagcaattcccctgcctcagcctcccaagtagctggaattacaggcacacgccgccacacccagctaatttttttgtattttagcagagatggggtttctccatgttggccaggaaggtctcgatctcctgacctcgtgatccacccacttcggcctcccaaagtactgggattacaggcgtgagccactgcgcctgccctgaaaacagattcttattgcacttatgcaaataactgtattgccacaccttaagaatactcacaaagtttccaaattctggagaaatcacataaagagaaacaaatgtgctccaaattttgttcataggagtataccaaattgttaaaagctgccaatagctcaaaagaaaagttttgagactctgaaaatgaaacaaaggatcagcaaacatattaagcaaaaagtcaaaaagattggtttagttcatgcagcgaaatcctgttctgcttgatactcttgaaaattttagctctccatgagtcctgaaactttttcctctattctgatgtcacaatctcccaagttatcagaaacctgcatttaagagcacctgttggagttttatagctgattataaaagcaccttgtaaaggggaccaaaacaagacaacaattgtccacaggtgaaaaaaagttttaaggcagtcatagtcaaaagacacaattgacaaggaaacttgttacctctggcacacaataatttttacataacaattatgattattactcacaatatacgctgttatatcagaattacatgagtttcccataattttggaacacataccaataatcaacttatacaaatacagcccaaagaaaaccaaaaatatttcatatttgacaatgctttctatataatttttataccaaataagccaaattatgtcatttttggactttaggaaactaatatcttaaaggattaattaggttagaaagagacataatttataacttgattttggaaagtttgtcaaatataaaaggtttaaaacatttgatattacaaaataagattacaggtcattgtaaaatcatttatttaaccaaaatgataattcaaggatttcaaaaaaaagcaaaaaccttcattcattgcaagagaagacttaattctctaaacaagaagccctaataaagacagagtgaagccaattacatttgtttttcaaaattttgtaaacaatctataaaatttaatcttgattataaaacttccataagccttttctaacctttataacctttattaaggggttggttcatgcttcaagaaaaccttgctaatctgacacaggggtccatatactggttttgcatcagcgtgcctttgacattaataattaatttgtagagaaactgaacttactttatctttcaaaattgacccttacaatcttatgctcccacctcttttgcaattgtccctgggtcttgaggagttgcatagctttaatttctggccctgtgtctcaggaatgtagtttgttttgattggcatcctctatggggcctgaagatgaggctttaattgttgccagtgtttaagatttaacaggacttgttgtcctttttagaccaaggaattaaagccctctaactcaatgttacaaggactttaaaagcatatacaggaagatacgtggatataataacctcaatttttaaaaaaaattatctccatttttttttcctaagcaaaccaaaacttaataataatatgacagcttgattatataaaagtttttgggttttttaaatatataaaccctcttattgtgactcacactgactgctcatcagactttctgatttgttttgaatatcccttctttttaaacaaccagttatttcattttagaatgaaactatacaagattctttcatatataatattatttctctttaagctttttttaacctcaaaaacaatctctttattttgataactttctttacatcttttttatttcctgattccttttaccttgttttatacataacctttaaataagctttgagttagacaaaacttgttcacctttaaagaaaaaaataaaagagacacacttgttttttgtttgtttagcaagaatgttttcctacaatatatatttattggaaaatacccaaataatgaaatatcccttatttggtttaatgtaactttataatctaaattatggccagtttgtctacaagtatttatcccattatatttacctaattattttattttgtttacatagattctttatgaaaattgtgatagtcatgatttaaagttatgaaaccaccattgcaaaattataactgagacagtggaaaaagatttaacgtaactgattccatattgctcttaacctccaggctgtccttgttcattcctgggctcaggctgaactacctttgggaggaacttagtttatagtttagctttgaaacaaagatgataacagtcgttttgcaaaacaaacctccttattgtctgtggactaaattgcctaaagccacaggattagaagttatggtaaccttactaaattcaagatggaactattttcattaaagtcatattgatgtcttatttattaaaaattacacaagcaaagatcattctgttttggaccaggtttatagttttgtaacccctatgccaaatttttaacaccttatagtgtttggcagggataagtatgaaatagtttaataaatgcaaacaaaaatgtatgctggcaattcttttttttttttttttttttttgtgacggagtctcactccgtgtcccaggctggagtgcagtggcacgatctcggctcactacaagctccgccttccaggttcacaccattctcctgcctcagcctcctgagtagctgggactacaggcgcccgccaccacgcctggctaatttttttgtacttttagtagagatggggtttcaccgtgttagccaggatggtgtcgatctcctgacctcgtgatccacctgcctcagcctcccaaagtgctgggcttacaggcgtgagccaccacgcctggtctatgctggcaattcttaagacatttctaatatgactttaccaagttagctcatgctggtcccaagcaccgatagatttgtcaaaggtcaggggcatctccactcagaatccccgcaatggttaccgaaatgtgaacccagaaaatctgagacaagtcttagttaatttagaaagtttattttgccagggttaaggatgagcctgtggcacagcctcaggaagtcctgacaacatgtgcccaaggtggtggagcacagcttggttttatacattttagggagacgtgagacatcaatcaatatgtgtaagaagtacattggtttggtctggagcaaaggcaggaagacttaaagtgaggaaggagcttccaggtcacagataggtgacacacaaatggttgcattcttttgagtttctgattagccttttcaaaggcggcaatcacatatgcatctatctcatgaagcagaggggtaactttgaatagaatgggaggtgggtttgccctaggccgttcccagtttgagttttccttagtgattttgggggcccaagatactttcctttcacaatttgctaagagtttattataataatgatacaattgaccaaaaaaagtggttatttctgtggcatacaatattttaacataaaaatcgtaattatgacagataacattttaatacatacatattatgtataagaaatcttacagaattttggaacacatgttaatatactcatacaaagataactcaaaactgttgaacattatttcttatttgacaattcctcccatgtaatttaatataaaaaataagcctaataagtatatcttttatatttcctttgggaagttccagggtcctttgggacatctcaaagttacactaaggtcaaaaagacttaatttagaatttgatctttgggaaattcatcttacagcaaaggtataaaacacttgattaaaatataatcacaggttactatgaaatattagtcatttacttaactggagtgatatttacagatttcaaaagcaaataaaagaatttatagacttgtagaaaaaccttaactctttcaatattcacttttcttaagtaatcagagacctaatgaagacagcatgaagcataggaaattatcttgatgaaacacagaatttttctctcttctttctctcctctcactttttttagtttacttaaaagagaaacaaaaatattttactgtctcttatcaattccacatgaaaattttgtttttaaaaggtcatgttctacttttgcatcagtgcacttttgatatgaagatttaatttttagaaaaacttataaatatcatctaagtttagccagcttgatatacacaaaatttctttcacaagatttatcttcaacaaacctttcacaactttctaatccattcattttatctatatcactccttttgttattcattcattctgcaaaaacatctaaataacctccaaactaagcaaaactctccttcctcaataaaagcatatcataatatctcatgacactgtaattttcttgtatactttgtgtacagaattatttccttatctctagtagtttaagttacatattagaattttaggccttataacttaatttccagtaaaaatccaggaagtaagatattttgaagtcttatttaccagtattttataagtacatattttataatttctagagacataagctttctcttagaacaattttttcatgtggaacaggacatgtttactaacatctcagatatatttgtctttatgtaaaatttaagaaaccaaaagtaaataaacttatgttcagcaattaatgtttcagtattttatcttatttggaactgatctagatcttcaatgagcatctgtcatttaacttagcaaaactgtaagggtataggtagagacttgagaaactaagtaagcaccttataaaatatagctttttaagagtatttttataaacttttacctaacttacatcttatttaattcattcttttttaacaattatgcctggaaaatttatgagacattagacaaagctagtcatcaaagaagataatctgtttgatttaaaagtcacttataggccaggtgcagtggctcatgcctgtaatcccagcactttgggaggccaaggcaggtggatcacctgcggttgggagtttgagaccagcctgaccaacatggagaaaacccatctctactaaaatacaaaattagccaggtgtggtggtgcatgcctgtaatcccagctactcgagaggctgaggcaggagaatcacttgaacctaggaggcagaggttgtggtgagccgagatcataccattgcactccagcctgagcaacaagagcgaaactccatctcaaaaaaaaaaaggtcacttattagataaaagtctaaaggtcctctaagttcttgttgtcttgaaatcactctacctaccacgttattaatttggaagcctatttttccctgttttggccagaaaaaatttaaaacttacagcaagcttttgaaatcagtaacagttcttttttcttgtgtctataggtctgtttaattgtctagttagtgtaggtgagaaatggctttcaaaggttattttcagggttggtgttttgttgttattgttgttatttttcttatccatgcactgcagacaaagcatttttaattgtcagataagcataccttttcttgttgttttcagttcaagattttggccaaagcaaaatagtggtttaaaaagtagacttggttaatctgtgttgcagctcttcactcttgttgtttggcaagtgggagggagtgttacagctcttttattcccaccatgggcaagcgccaggctcttgtcccatgacaaggaagaataaggcacatggacaccagagagagtgaggcagagtcagatttactaaatgatagaaaagcacttagcagagagaggacccgaaagccacccatgagtctgagtttgggggtttttatggactgcaatgtgagaggagtgtgctgactggtctgcaagctgtcttggagacagcaccactcaaaaagaggtatgatagtgtaaacagccaattgaaggcagaggtgaaggcttggcctgggacgttggcctgggacaaatcagtggctgaagtgatgattcactctatgtaaatgaagattcagcttgttgtcaatcacagaaaggtaggcgtatataaaataagtgaaaagtaagagactaaggtgcaccaaggagagagaaatgtgtccaaaaaggaagtggaatttgttcatctgggttcacagagtaggtgtttccattcaaggatgctggctccttcttatctggggcctgcagtttgattttcaggctgttcttggtttgaaggagttttaccagggacccaccctaattgcctgcctgactggtttcttcctttctcctctctcatgagagtcatcaacagattcagaataaaagttgtatgtctacagtgtatttattgctgatagatatgtctgcttaaattaaaccaatagtattaaactagtattatttaccaaagatttacccaagtaacataaacttagaaagcatttgggttagttcctatattttatcatctttaagcatatattttatatgagtactcatttatgtctttagccaattaaatagactattttaagagattttatatcatatagacataatgtgcaagtatacatatacacatgtataaatatacacaaacatacagatagacacaaacaaatatcttgtagcttttatttttaaattttagttaagagacaggtataatagtataaaacttactagtctataaaaggacagttagatccattagaaagaacagagatgcctcaaaatatatattgatagattgataggcatagcctgaatatcagcttccaattaaactaacttttgaccatagacctctttattaaaaatattcttttcaaatatttttattatcaaatttagctggggcaaacagcaaacaattctgcttcctagcttctcgttccctgaaatttgcatttgaaaagggatggtttcttggtaaaactgattaggaaatttatatctcaaaggctcagggaaatacagttttcaccaagaaggtattttggggaggtatatttgcctattaaaggtctaggataattgctattcaaaattccttttttaaaaagtgcaagagagccctgtttcctgatgcttttcagtatcagataacatcctgaggtgaataggtgaggtttggggttttctttgaattgctttaaagcaattaaatttttgtttttgtaaagactcaatttgtaagacaagaatagttactttttttttttttgagatagagttttgctcttgttgcccaggctggagtgcaatggtgcaatcttggctcactgcaacctctgcctcctgggttcaagcgattctcctcctgcctcagcctcctgagtagctgggattatagccatgcgccaccacacttggctaattttgtatttttactagagactgggtttctccatgttggtcaggctggtcttgaacctacaacctcaggtgatctgcctgcctcagcctcccaaaatgctgggattacaggtgtgagccactgcgcctggcctaagaataggtacttctaattcccttaagaattgggtggcagcctgaatgattttaagggactgtcccatctatccaactatattatctttaacttatttctctctatcaaggagcagattttcaactaagatgaaaatcaaaagatctttctgttccagatatagacttaattacctttgaaatgttttaatatttttttttctgaatatatcgttccattttagctaaggagacaaggcaaaaaaagcaaacagaagtttctgtaagaacgaagtttcaaaccaaaggtatacctggaaaatgactcaaggcaaaattaatacttaagacaaaaccaataagactttaaggctttaattaacatctccaaaaaaagagcaaaaatatgcatccctttcaaaatacagaccctcccaaaaaacagccaaaagcgagaaaacctttgccagccacaaatagggtacaacaaacattttcctccagagacattcttaagtctcccaaccttttggctggctgcctgcaaacaaaggcccaataacctgtgggcctttggtggatgcaaagtcataaagacaatagtcagtaagacaaagagaaagacaagcttgccattaggtgtagggggaaggatcactaatgtaggggccaagggaagacttcccccacttattgtagggacaataaatgattaccagagagaacaaacggatcagggagcagagattaacctgtaaatgatcctccttggaaactgagcctgaaagagggacattatcttgtgaatgggtctggtcaggtgtggttccattcttcagtcttcttttctataataaataataagatgacatggaggggaaggaaacacaattgctccctgtggtctttatgtaggtggggaaggtctgccagcatctgttgatctgtaagggcccgtaattcaaaatactgattataccagggagccatattttagagtaaaattccctgcactcctttactaacaataagcctttatatgacttaaaaccacagatgcaagtatcaggttccaaagtgggtgcaaaagatgcagcccctcaagatctaaagtttttacctaagataccctaggaaagcaaaaactctcattattaacaaggtaacgaaggttgaggcaattaagacaaactcctgagagctggcatggtgagacaaatgtttggacttctagctagccggcataagtacaacaacttgtgatccccaggctggcccaagatactacaaagactaacctttgagacacagcagggaccccctattagggccctgagagccccccaaaaagcatggaaatatggaaagatcttgagttccttcaaaggaaattccaggcacatagctagccctgagaagtaaataaacaacttattaaaggagataatagtagcctgaaacgatggccaaggaagctggggtcaggagatgtttgctttccctatggaaactaaggatgacatcttaacatatgtccctgagttgtctttcagaaacatggacccccaccaggatccccacagaacagattcactggcatgtagacctcaaatgagggagaactgaaggctgaactgtgaccaccactctttgtcccaaatgtcttcctgagaggcctggtgggagtcacacccatgagctggttaacattcttttctgctgatccctaattttaaaataaagcttctcttccttaatcaattgcaaatcagaaaatctttgaatgtgcccatgacttgtaagcccttgctacaggatttcccacccttttaggccagaaccaatgtaacctccatgtattgaattatgatttttcctgtagcttctactcctgccttgaaaaattcttgcctgcaaaccatttgggaggccaggatttgaagatgagctgtctggtcctgcttgtttggcaccctgaaaataaatgacttcctttctgccactgcaacctcagtgtggatatctggttttactgtgttgggtgagtggactccagttctgtaacaccttgctggttacaaagccaaactctcaaaacataaagaaaaacaaaaggaagatattttcataattttcctccttaagacaaaccacacaaaagacagagataaggaaaacaaagacctcctggaaggctaaagatcaataactaggctgggcttggtggctcacgcctgtaatcccagcactttgggaggccgaggcaggtggatcatgaggtcaggagatggagaccatcctggctaacatggtgaaaccccctctctactaaaaatacaaaaaattacccgggcgtggtggtgggcacctgtagtcccagctactcaggaggctgaggcaggagaatggcatgaacaaggaggcggagcttgcagtgagccaagatcgcgtctctgcactccagcctgggcgacaaagcgagactctgtctcaacaaaaaaaaaaaaaaaaagatcaataactaacaggtgcccaaaccaaatccacaagagtcaccaattcaaataattaattattttttcaaaatcatttttttctgttgcaaatttgaatttaaaaaacaaaaaaaataggagttttgttttttttttcctttctctctcagcgaggcactacacatagagatacgagagagctcactttggtaaaaattctcttttttctgccagcttctgccacttctcccaggatcacatctgcagctgtcagggcaagtggagtgtgccagaatctcttggctagatcaccaaaatcaagcagagaaaataaaaattttaactcaatcctcccaagttcacagttggaacagactcctgtaacacgagactgattaacaaaagaaaaataggtgacttattaacacatgcagtgcacatcacctgtgagaaaaggaactcaaagcagtgatctaggacttacataaacaaagaacaataagttttatacaagtgacaagacaaagaaaagcagcaccagacttccaaacaccagaaactgtgggaaggtaaatatatggaaatacactaacgaagtaaaaatctgctcacagattcctctgagccatttctgagctgatgagcgttggagtggagaatttacatccgtgtttatgtgagaaaacaagggaaggataggaaagatgttttcttctatcaatctctgtcctgcttttaggcaaacagagagggaaggcagagactcttagttgagaatctaagttgtcttagagaatcttagttgtcttcagttcaacaatatttatgtcaaagaggcatactttgaggtgacacattctggtttccttcagttcaaagaccagattttgaaggaaagacatgactgataaagattattcagggatttgttcctctctctttagtacaaaatagctataaaatttatgctgttcacaaatgctgggggatttgaagagttgctgaattttgagccaaggacatgtgtatgtatataaacaatgacatgtatatattttttctttttataaacttgtaaatttcttgaaatccaaaataaattcatataaatttgtcctccaattgtgacttctaagaaatatttattaaatgaaagacatcctaacaatgacactaactcgtcctccagacatcattacagttggctccttgtcatcatttggcccccagtgcaaatgttcctcctcagcagtgctatagaaagcagctccaccttccctaggcaccctctacagtatcatctattcattatttaattgttttcacagtattaatcagaacctgaaattatcttattcaagtatttggttactgacatgaccactctccttcatcctggaagcattatgataactaagacctggtatgttttcttaccattctactcctagtcccttgaacagtgcctggtatataataggtaaatactaaatatttttcgaatgaaggaagggataaataaatgggttcagtagaatccatttcactcaacggaatccaactgaaaacatactctctagtcagcaaggtttttaacatgcagattagaagctctggggaggggttgattgtatctaggaggatgtacttaaatttcttctttgggcataggggcttctggcaaattttgtagcaaattagtatttctattggaatcctagtcagatatttctgagttttagacctaagtagttttcacatcaattatgaaagataaaattatttcaaaagatacttgaattcaaatctagtatatagagtgaatgcattttaaaagttaaaaaaataagaaattaggttatatttgaaagaatctcagctgaagatttttgtgcttttattacaaaggaagaggtaccactctcgccggttttacatcttgcattttaaaaagttaagtacagccagacacggtggctcacacctgtaatcccagcactttgggagaccaaggcggaaggatcctttgagcccaggagttcaagaccaggctgagcaacatggtgacaaaattaaaaaataaaaataaataaaaatgttaagtagtgatacgagaaaggagcaggaaagtgctgggttgagaaagatggggtccctggtgagagcttcactctcgagcctgtgcccacggacccaaatgaggacaggcatttctgattttgtgtccaaaaagttgccctttggcccacgacaccccccatcctgtgcccataaaaacccaggacccaacaggcacatacacaagtggctggacattgagaggagcagaagaagacacactggcagacatcagcaggccagtgataatggaacgacacagatgctgaggggaattcggccaggtccagtcgaagaagagtccagtgctgggcagcccgactccaggggaaggccacctttccactccatcccctttccagctccccatccatctcactgagagccacctccaccactcagtaaaacccagcacttgtcctccaagcccacatatgatccaatttttctgatacgctagagcaagaacccgggatatagaaagccctctgtccttgccataaggcagagggtctaatcgagctgattaatacaagcttctgcagacaacaaagctgaaagagtgcactgtaacacgtgcccactggggcttcgggagctgtaaacactcaaccctagacactgccatggggtcggagcccagaaatgctccccacaacctgcctgcctgcatgctccccgtaggggtttgggcagcagggcaagccatgcccctgtcacatgccctgagaggggggataagggaacttcttctgttttagtaggaagtactcgtctagctttcctaccagttaaaaataaaatcaaggtcttttggcttgtgtacaaaaaattcatcaggattgtagttattgtaatgcttattaataatctacaatggatcttcagttcaactcaaagtcatgatggacactgtttggcctccagctatgatctcagccttagtgttgaagaaagcccctgaaatacgggcagacagtgatattcagagccgcatgtaaagagcctttcggaaatcccctttgctctgccctgtttcattccacatccgtctgcaccttagccagcattgcatctattctaactaattggttcttaaaatgataaagcagaacaacagataacaataagaaagtcctggactgtgggcgcttctatttgtagagaatggaagactaactgagcctatcaatattttagtctcaagagcattacccctggacagtataatgctgctaacttgtctagagaagtatcattgtacgtgctaagtaataggaagaatatgtctagcatcaattataagttgcaattcacactgtgcagggtgctcttcaaagccgcaataccttcatccttacacaactgtaaatcatgattttatttcagaatagggtctctgcttttttactcactttgaaaagaatctgacacagtgtgaaagtgaacatttaataagtacttccttctacacctgcacacagggaatggatgataaatgctgttgtctgagtttatcatgataagacgaggcacaatggagagacaattaatgaatatcctttgattgatgataagacaagcagtacaaatatggatttttcttcttttgcagctcttctcaaatagctctaaacaaaagcaaaacatgctctggccacagaaaagacttacgacacaagattatttcttattgccattaatttcatcttaatagacattattagcttattacacagattatattatattatatttgcataaatttatcacatagcttattatgtgccacacaccatttacatgctatatacatgcaaatgtgtttagtcctcaaatccaccctaataataatgatggtgataatcataacatactattatgattcctatttctacagatgaagagaatgcacagagagaaagtatcttgtcaaagagcatggtgctagtaagtgtcagagtcaggatttgaacctaggtagcccagtacctgaatgtgtgtacttacactatttatcatttatttatatttatttattgtatttatttttattatttattatcatttatttatttttatttttattttattatttatttttattttttattatttatcattcatttaatatcatttagtgtaggaacaccaaatgatgtagtgaagtaattttctttaacatgctcaacacataaaggacttcacactataataaacccagagatattttaatgagctccataggaacatatctctaagttagtcatttaacttaaaatcccactgtacctagcttccactattagtaaatcaaagagtgttctatcaaaaaattccttttctccttacctccaaccctccttatttcatagaccttgcctaccacactttctaaatggagatgtagtcccagttgtatttctactgttcagagagcgaacaggcatccgtctccaactacaaactatacacttgtgctacgtgactgagaacagcatgtggatgcaagttcaccttggaattccaccacaatgaagctgtttgtgagccgctttctgcttaaagaacactttaagtttcctcagtaaacatcttttcataatgtgaaggtaatctcaaattttatttaatactaagtaggtcataaaaagttagagtttataagtttcatttgaccatttcttgttgaaaagattttggaaatgaggacataggtctttcttgaggcagaaagcattatggatataaagaaaaagataaagagcatagggtcagagagacctcagtttaaattttaaacacatctgagcctcagtttgcacatccttaaaatggggtaaatactacacctgacacacataaggtttatctgtaatgtgcaaattaacaatgtccttgccaacataatatttaaaagtctgctttgttcccaaccttgttagaatttccatttgggtcttctgcacattatttttcaataaaatgctgatttttcagtccttgaccctcttctcttaactcttggtagtaaaataaatctctactcagacaattactaaagttccatctccagcctggacctctcccatgaaatgtgactcatatattcaactgtctgcttcacttctcttcagaaatattataatataataatattattataatggtgtaatatataataagtatctcaaatgtaacttcttcaatactacacttttgacttggacactcaaccatagttcatgctgcagtctttcttatcacaatagatgacatctcttgcttcttagtacacagtcctaaagctctggagttgtccttgagacatttttctctgaaacttatatcttgacaacagcaaattctatctattctacatgtttaaaaatatttggctgcttcaaggtcagaaagatattctcctatttttttcttataaaaacatcactgtttaatctttcatttttagatctggaattatttttgtgtgtattgtgaggtagaagcaaaatacattttttgtattgatttccaactgacctacagccatttattgaaagggtcatcctttctcccactgccttttttgtcataaatctagattctctactcttttccgttggctttagccattggcatacatagttaagatttaattactatacctttataattggcatttatatctaaaaatgtaaatcttccagctaaattctgttttccttgactattcttgatcatttgcaatttcataggaattacaaaatgagcttgttaatttatgtaaacacacatgcatacacaccctgctaagatataggattgagattgtgtggaattccagatcagtttagagagaattgacaaaaatgggcacaagactgaaccagcacttaagaagagtatatccaaatgaccaataaatatatcaaaactttattcttcgtcagagaaattaaaattaaaatcatattaagattccactacatatttgccaaatgtctagaatgaaaaacacaggtaataccaaatgttggtaagaatgtagaacaactagaattctcaggcaaaactttggaaaagcatttggccgtgtctactagaaatgaccatatgtatctcctatttcttggcaatttcacatctaaaatatgtgcaacagaagtggatatttatgtccaccaaatatgtatgtatgtttgtgggtttgtgtatatacatatatatagaaaactgaatgagagtcaacaataggatggataaatacattgtgctatagtcatacaatgaaatccaatacagcaatgacaattaacaagctacatctatacaaagcagtgctgatgagtctaaaatcatagtaggcaaaataagttagacccaaataatacattttgtattatttaatttatatatatttcaaaagcaatcaaaacaaattcatggtgatagaagtcagcatagttgttccccctggggaaaagtgattcaaagagacacaggatgagccgggtgcggtggctcatgcctgtaatcccagcactttgggaggccaaggtgggtggatcacctgaggttaggagttcgagaccagcctggccaacatggtgaaaccctgtctctactaaaaatacaaaaaattagcctggtgactcatgtctgtaatcccagctactagggatgctgaggcaggagaattgcttgaacccagaaggtggaggttgcagtgagccaggatcacaccactgcactccagcttgggggatgagtgaaaatctgactcaaaaaaacaaaaaaacaaaacgaaacaaaaaaaacagagacacaggatggctctgagatgctggcaatgttctgtgtgttatctgcatgctagtcacagtgatggcggtggcagcccttctggagcagcctctgcgggacaccagctgcagtgggggaggtgtggccggggctgcgtgctacacagagtcagccaggttgggaacaagtgggagccccaccccttaccaagttggcaggttgggagcccagtgctctgggaacagctgcagccacccagccacggctctggactcggcatccctgcggtctcagtggcccaggaagccgcccccctcaaccaacagacttggaattgcctcctcctgttccctggtgtttccctgctcccattgcctccaattttggagcaaagttgtggcagagccaaagtgctttggcaacctggccatgtatgtgtacgctcagggcagcgctgacacaccagccccctgccacctcagccccctctggactttgggtgtcaacaagcatgggagggaggctgaggggacgctgagggtggctcagcatgggcctgcaggtgcccctcagcaggaacagccttagtgctgtggatggcatgttgatggtggcaggaggcaggctcctgggtggaaaggcgtgggtccccagtgaaacccaacctttaagccagggacagactgaagcctggggaccaagctgccagctccaggtggagtctatggccaggagtgagaacttatggtgctttttctgggccgcccatggccatccatggaccaatcagcacgcatttcctcccttctgagcccataaaaaccctggactcagccagactcaaacagacattgagactaccagctgcttcataaattagttaataaaagctagtgagttttgaatgccacattagtagaatgaacactttttttttcttcaattatcttaagctcaggggtgcatgtgcaggatatgcaggtttgtgacataggtaaacgtgcaccatggtggtttgctgcacaggtggtcccatcacctaggtatgatgcccagcattcattagcggttcttcctgatgctctttctcccactcccaacaggtcccagtgtgtgttgtgcccccaccctccatgtttccatgtgttctcagcacagaatgggcgtttgaaggaagactttgaagaagaaaatgggaatgatttccagtaagtattttttatcagtctttttatgactcatacaaatatttgtgggcctaaagtaaatgtaaacactaatcttaagaaatatttgtcctttttgagttttaatgtgtctttatgtttgcatttatccaattaatatcagaacaaaaatatataataagtactagagacaatttaaagaaattaaactgtttccagaaggtagctaaataaatcattacttgtatttagaggcagaaaatagagaagtaaaatttaatgctaactttagttgatgtactgtgtcatataatatattgcaatttttagctaatttaaattaaaatagttatatcaatgattttgaaaccatgaagcaacaattatcataaatgttgttttttcaaaaattagatggttccagtagtttttgctacgtgaaatctctgactactacatcatctaaggcactttttacgtttcgtttataaagctcataaaataacctaaatgaaaaagataaatagtaaaaagcctgaagagctgatggagctatgtttcttgatttattcatctctattccatatctgaaaaaataatttatgacaatttctttgtatggaagaaaaattttataatgtttagatctattgggggaagaatgatttcctaggatttgaagctataagaataatggaaaaaaagatatatcattcttctatcttttatcatgtgtaaagtcgatttttaatatggcaagatattcaatctaaagccattaaagatatttccaaaaccttacaccagcttcagatatgttacctattatacaatgactttatttttaaaaagtaaggaaatattcatccttttactagtagtagatgattggacagctgtcttcattggtaatttaaatgtaattttgcctgaagtagatagaaaaactaatcacctcttggggtcttttacagtgatataattttatgccaactttcaacactagaaaagtaagcatattctttatgaaataaccagaatttatagctgaaaggaattttagaaatctagttcaggggtcagcaaactactgcccattgcctgtttttgtaaataagattttattgtaacagccattctcatgtttattcactcatttgttgaaatgttgtctatggctgccttggtcctacgatggcactgtggaccagttgcaaatgagaccatatggtctacaaagtaaaaatattccctagaacttgaagtataataaaaaaaaaaattatctagccctttacagaaagacctgttaatctctaatctagttcatccacctcttttacagatgaagaagttgaacccctgaggaataaagtaacttgcccatggttacatagacagtaaaagttagccgaagacacaggtcttttgctttcagattcagtaaaggtctcattacattatcccactactcataatgtaaaataatgtgtttgatattttctagtattcatgttatgatgaaataatcccttggtaagtaaaattttccatacaggcagtcagtctgcctctgttagccttattcttttcccttgaaattcagaggaaaattttaaaggtaagaaactgaaacacatattttggtccttatattgtcagtgtttctacataaggaaaacaatgtgactaaaacagatgacatctattattggatttccactcaataaaatgtttattttctctaatcaactccactttttttttctgcccattagtgttatccaagtaatacatcacgtaaggacaccattaagtagaatgcctgtctgtatctacagaaaatgagcagatggttggttcctcaaacatttaaaataaagacaaatgtagtcttgggtttaggggtgagacagtggcaggcaggacacttgggatgaaatgtataatgacgttgtactccacactccctgcatgtttacaatgtactatagatgtgaaagttaatgcaccataaaaaattgttataaaattttattttattttaagagcatgagttgggtctggtcactttcttgattgtgttaatggttttatgtgtttattcacatgacaaaatttaccagattttgtactttaaatacctgcagtttcttaggtgtcaatgacatctttaattgaaaaaaaggagtaacagaaaacaaaaacaatgagataaatgttttttttcttttttagcaagaaaagaaaatataagctagtcatttcagatacatgtatgtattgacatcaggtttgtttgtgacaaatcttcactctgtgacgaaaaagtacacattttcctgttggaccaaatctttgtttattcttgtagcttaactcaacataaagaacatgatttttatttcatatttttgtggtgataaatattttcatgcaaatgctttatatcagatggaagaacaaattactaaaacaaatacagttcatatccagtattatgtattcaccagaaactgttatattaatgattctagtttaatgcagagaaaatttcagttctgaagagtacttacgaagacacattttgtgcattaatgcaaaactgtagaaacatgaaaagtacagtgcaataaagaataacaagataacatgggtctagagtacatttttccaagtttgaagttaaataaaattatttctttcaagaacctaacttctactttaattaagataggaaagaagtcagacttacaattgtttgtttttgtattagcccaataaaaatcctagaaatgatgttctttatgtttctaaaataaggaagagtatcctggggaagaaaataacacttctttagttaagttgtatgttgtgtgcctagtgaaaatacccacgctttgttggtaatatcccaatttgccatcttctttccatatttgctctcaggggattagtgttgacttctaaggagttaaagctgctcttagaatcatcttttctaacccactgtagctgtctggaaaacagtaagatcccaagggattttacaaaatgtaattcttcaacatgcacaataaatgaaaagaataatttatatttcatacaactctaattatcatatggtaaaaggaaaaagaaaggtcatatccttgaagttacaaattatgtatacgacccatctgaagccatcactttcatacaaggtaggtttatggctcattaactctgttctgtgtaacatgagttatatgatcttactgtttatgcattttaaactatggatatattgattattatatatttctaaataactagtgtgtaaaattatgacaggaatgattggatgtatcttgggataaatatattaactagaattagtttcttctcaactattggaagaactaaaacaaaattcttaaacagaagtgattcaaatgatattgttattctaaaaatcaaaaaatcttttaaatattcaacaattacagcaagtgggacacaatatgtgttccatttttttcttgttttctgttttaaaatctgaaataacattttatgtatacctccaagagcccaggctgcagtgcagtggcaggatcttggctcactgcaacctccaccgcctaggttcaagcaattctcctgcctcagcctcacaaatagctgggattacaggtgcacgccaccatgcccagctaatttttgcatttttagtagaaacaggtttcaccatgttggccaggctgctctcagactcctgacctcaggtgattggcttgcctcgacctcccaaagtgctagcattacaggcgtgagccaacacgtctggcccaagaagaaattttaaagccttctcatgacagctattcgcctagaatttgacatgataaaacttttttattttaaaaaagagaaaatagaataattctccactcttgacttgtacatttgaatcaacattaagttgtcgtgggattatctttaaacaaaggtgatgggttttgtcatggggctgaggagtttcatttgctttattttattataaaatgaatagtataatattctaaactctacagaagattatacagtgaaaagttcaagtttccctctgcccttctctacccaatctttccctcctgaagtaaccacagttaacaactttttgtgtactgcttaggttattttctttctttcttttttttttttttttttttgaggtggggagagggacaggatctggctctgtcacccaggctggagcgcagtggcgcattcactgcaaccttcgcctccttggctctagcgatcctctcacctcagccttctgagtatttgggactacaggtgcgcaccaccacacctagctaatttttttgtatttttggtagagatgggatcttgctatgttgcctagcctggtctcaaactcctggggtctggccatccaccagcctccacctcccaggcaatccactcacctgagcctcccaaagtgatgggattacaggtgtgagccactgcacagagcagtgttcgggttattttctatgcgtatacatataggttttatagtgccaaggcttgtagagaataggtgacagccagtgatcaaagtggaatattttagaagaatagaaagcagtattcaattcaataaaacacttttattggacacctgctgtgtgcaaaaccacaataataaatttcacagaaggcataggaaagcactaggatgaagaagtcaccgtagttctgtcttcaattggtatgtgtttctgaaatgtgcaaacaccattactgcaaaaaaactcaagaatgttacgcagcattaaagactgtttgggagaaaaaaaacacagcaggattgactctactttgatgaatttttaatctcatcatatagtcatggaagactgacactgaatagcatatttgcagaagggaaatatcctagcatggtccaagtttaaactacatgaggttaagaaaatagctgggtaacattttggattttatccaacagacaaagtagtgacattaatggttattttaaaatagtctatcaatatcagatgtattttttttaatatatatccagttgaaaggagaatggatcagagatggaaaagaataagatgagcaaaacaggcacttagtgtgatcctccaggcaaggacccaacttaataggagccatagtaagactgaactcagagacatttcagcaaaggtgggactggcatggatgtggggtatgaacacttgaatttggggtatagaacagacaacttgggaagctacaggatttcttgtgtgagtgattgtgtagatgttgaagttgttagttaagaaagagaatatagaagaagtagctggtgcagagtgggaagaataataaacttggctttgcaaacactacatttggattgtctatgaggcctttccataaatcctcccagaagcaatgtgtgggacatttaagttcattgactgtgtggaacttggagccatacagttaaagattatttgctagagttagtatcactccacaagatttttatttttttatgtcaacctttattttggattcagggagtacatgtgcaggtttatggcatgggtgtgcctgggtgttcataggtggcaggcttggtgtacaaatgaccccatcacccaggtactgagcatagtacccaatatgtagttcttcaggctttgtcccccttcctccctctcccttcaaatagttcctagtgtctattgttgccatctctatatccttgagtacccaatgtttagctcccacttaaaagcaagaacatgtggtatttggttttctgttcctgcatgaattcacttaggataatggcctccagctgcatccatgttgctgcaaaagacatgattgcattcttttctgtgtctgcatagtattccatggtatatgcataccacattgtctttatctagtccaccactgatgggcacgtagcttgattccatgtctttgctattgcgaatagtgctgtgatgaacatgcaagggcatgtgtctttttggtagaacaatttgttttcttttggatatatacccagtaacggagttgctgggtcagatggtaggtctcttttaaattctttgagaaatctccaaactggtttctaagaggtaaacacatccacctagctgaaaatgctaaagtgggtggtaaaaagaggtggacacagaaggagagcacttcatcatggaagagaaatagcaccttgatctcaaacaggcacctcatcctcctgctggctcacagggctcagcaccactcccgctctggcattggtccaaagactcctttcgttactgtgctcctgggctgtagtgacgggtctgtctggcccactctttgttatcagcagccattcctccactcacattctcatcttactagattttagttagtttctctttcaccctcttgtccccaagagttagaatttattttgagtttaaagagtttttactactaaatacttcatgaaaaaggaaaagattttaaaaaatagaaacaataagaaagtgataagaattaaataaactcttaaatgtttttaccttagtattcatgttcatctttgaaatgtgaggaaaacacaatgagtggttcttagctatcttcattgcctcaagtcttgtattttccttctttgcatcaaaacttttaaaactttaatgattttttttatcccacaggctcttcccctgagtctttaccaaatcttctaaccatattctttcccagccattacactgggaagccctcaaatcaatctgaatgttgaacagcaactgcatgcacctgtaagactcatttataattcagagattatcacatgattatcacatgatcagtgtttttgctgcttaatggaggaaaatgctccgtgttattcttttttttttttttctgttgagacagagtctcgctctgtcgcccaggctggagtgcagtggtgccatctcggctcactgcaagctcggctcccaggttcacatcattctcctgcctcaacctcctgagtagctgggactacaggcgccgccaccacgcctgctaatttttttttgtattttttagtagaggcagggtttcagcagggtcttgatctcctgacctcgtgatccgcccgcctcggcctcccaaagtgctgggattacaggcgtgagccaccgcgcccggcctgttctgtgttattcttaacataattaaggacacaaagtggaatataagatatttttgtcttctccatgttttatttcagtttcaacaacaataaacatttactgactgcttcctggccagaacactggaaaataaaagaaagtgttacgtgtgtttttggttctcaaaaggcttactaaaggatagttatgtaaacactggaagagaacagataacctcagaagagagaattccctacataaccagttagcatatcctaaacaagatatcacacaattatgctattaaaagggatattttatatacgtactatataaaaatatgttttatatatttttatatattatatataatgcatatttatataaaataaacattattgaataattatttttatatttgggaggaaggtcaatttaaatccataccacattataacccaaaataattctatttaaaaatattttaaagactatttttccccaaatctcaaaggttctctttcttaggttctctttctttctttcttttttcaaaaaaattttaaggaaaaagccatgtacaagattttctttcttaaactgctaaaagcatcaatagatttgaggataatggcacacaagaatgttatgtttaaaaatcatccaagttagaaacataaacatgcattagttaaatgataaaaggatatgaacttgcagttgaaacaagaggtagtgaagttttaactaaatgttggctttaaaatgtggtaaaggaaccggtggagggagatggctgaaaagaagaccctactgaccatctccccagcaggaacaccaacctcaacatctacacaagaaaagcaccttcatagagcttaaaatcaggtgagcactcacagtgtctggtttaaacttctaatcgctgaaagaggcagcgaagcaggtaggaaagggtcttgaatcaccgaggccacccttcccccatcctccagcagcagctgcagggcatggagaatctacgcacttggggaaaggagagcgcagtgtcggtgagacatcacatgaacttagcgcttccctgtcaccgtggaaagcaaaaccaggctgaactcagctgacacctacccacagagggagcctttagactagcctgagccagaggggagttgcctgtcccagcagtcagaacttgagtctggcaagccttgccaccatgggctaaagggggagctccaaataaacttgaaaggcaatctaggccgcgaggcctgtgattcccggacaggtccttggacaggtcctagtgctaagctgggttcgaagccagtggacttaaaaggcatacaacctactaagacaccagccagggtggctaagggagtgcttgcgccattcccccaaccccaggcagcacagcttacagctctgaaagagatcctttcattccccttgcagagaggagagggtaaagaggactttgtcttgcatcttggataacagctcggccacagtaagatggacaggtacccaccagtcagggttgtgaggcctcctttctgggccctagctcctggaccacatttctagacacaccctgggacagaggggacccctctaccttgtagggaagaaccccattgtggcaggaaccattgcctgatgactaaagagcccttaggccatgcataaccagcagtgacacccaggtattattctgtgggccttgggtgagattctgagacttactggctccagatgagacccagcacattcccagcaggggtggctatggagctatggctccttctgcttgagaaaccagagagaaaactaaaggggactatatcttgcaccttaggtaccagcctggctacagaggggtagaataccaagtgagctcttgaggtcttcaattccagagcttggctcttgaatggcatttctggacctgccccgacccagaggggagcccactgctccgaagagtgagtgccaggcctgacagtgttcaccgcaagctgactgaagagccgtttggccttaagggaatatcagtagtagcccagaggtactcccatgggcctgtggtggtggcagccaccaggcgagtctcctctacctgtgctaaggggaaggaagagcgaggagggctacatctcatggtttaagggccaactcagctgaagtgtaatataacactaggtagatttctaaggtttttgactccagtccctggctcctggaaagcaccttttgaccctcctggggcctgggggcactcagtgtcctgaagcctggctggctttgccatctgcttatcacagagctctagggccttgagcaaacctaggtggtagccagatagtggttataggaagccttgggtgatacccagcactgtgctggtttcaggtctgactcagcagtctcagtggtggtggccacaggggtgctcgtgtcactccaccccccggtccaggcagctcactacagagagagagagaggctccatttgtttgtgagaaagtaaggaaagatagtgagattctctgcctgacaatccacagaattcttcttgaccttatccaagaccaacaagtcagctcagtcttactgagcttgggtgccctctaatgcagatacagcttagaccacaacatccaagtcttttcaaatacctgaaaagcgtttccaagaaggttgggtacaaataagcccagactgcaaagactacaataaatacctaactcttcaatgcccagacaccaacaaacattcaaaagcatcaagatcatccacagaaatatgaccttaccacattagctaaataagacaccagggaccaatcctgaagaaatacagatatctgacctttccaaaagacaattcaaaatggctgttttaaagaaactcaaagaaattcaagctaacacagagaaggaatttagaattgtatcagatagatttaacaaagagattgaaataattatatagaatcaagcagaaattctggagctgaacagtgcatctgacatactgaagaatgcataagagtgttttaatagcagaactgatcaacctgaagaaagaattagtgagcttgaagacaggttatttgaaaatacatggtaagaggagacaaaagaaaaatgaataaaagataatgaagcatgcctataggatctagaaaatatcctcaaaagggcaaatctaagggttattggccttaaggaggagggagaggtaggggtagaaagtttattgaaagggataataacacagaacttcccaaacctggagaaagatattaatatccaagtacaagaaggttatagaagacaaagcagatttaaccaaaagaagacaacctcaaggtatttaataatcaaactttaaaggtcaaggataaagaaaggattttaaaagcatcaagagaaaagaaacaaataatatacaatggagtttcaataagtctggcagcagacttttgaatagaaactttacaggccaggagagagtggcattacatatttaaagtgctaaaggaagaaaacttttatcctagaatagtatatctggtgaaaatatccttcagacatgaaggggaaataaagactttccactcaaacaaaagctgagggatttcatcaacaccagacttgtcctacaagaaatgctaaaggagtacttcatcagaaagaaaaggaaactaatgagcgataagaaatcatctgaaggtttagaactcactggtggtagtacacagagaaattgagaatattataacactgtaactgtgatgtgtaaattactcttatcctaaggagaaagactaaacaatcaaccaataaaaaataataactatgacaacttttcaatatatactaaacagtatatactatactatactatactatactatagtatagtatagtttcaatactatactaaacagtatagtaagatgtaaagagaaacaataaaaagtaaaaagcaaggggacaaagttaaggtgtagaatttatattagttttctctttgtttctttatttatgcaaacagtgctaagctgttttcagcttaaaataatgggttataagatagtatctgcaagtctcatggtaaccgcaaattgaaaaacataaaacaaatacacaaaaaatagaaatcaagaaattaaatcataccgccagagaaaatcaccttcactgaaaggaagacagcaaggaaataaaaaagaaagaagaccagaaataaccagaaagcaaataacaaaatggcaggataagtccttacttaggattaataacattgaatgtaaatagactaaactctccaattaaaagacacagagcctctgaatggatgaaaaagcaagactcaaccatctgttgcctaccaaacaacacgcttaacctataaagacacacatagatggccaggcatggtagctcatgcctgtaatcccagcactttgggaggccgaggcgggtggatcacctgaggtcaggagttcgagaccagcctggccaacatggtgaaaccctgtctccactaaaaatacaagaaaattagctgggcgtggtggtgggcacctattatcccagctacttgggaggctgaggcaagagaatcgcttgaactgggaggtggaggttgcagtgagctgagattgcaccactgccctccagcctgggtgacaagagtgacaccccatctcaaaagaaaaccaaaatgcaacaacaataacaacaacaaccaaaaacacacatagactgaaaatagatggatagaaaaagatattccatgtcaatggaaaccgaaaaagaggagtagttattctttttttttttttttttttttttgagatggagtctctctctgtcacccaggctggagtgcagtggtgcgatctcggctcactgcaagctctgcctcctgggttcatgccattctcctacctcagcctcccaagtagctgggactacaggcgcccgccaccacacgtggccaattttttgtatttttagtagagatgaggtttcaccatgttagccaggatggtctcaatctcctgaccttgtgatccacccacctcagcctcccaaagtgctgggattaaaggcatgagccaccgtgcccagccaaagaggagtagctcctcttagacaaaatagacttcaagacaaaacccgtaagaacagacaaagaaggtcattatataatgataacagagtctattcagcaagaagatataataattgtaaatacatatgcatcaaacagtggagcactcagttatataaagcaaatattattagagctaaagagagagtcagacttcagcacagtaatagctagagccttcaacaccctactttcagcaccgaacaaatctgccagagagaaaatcaacaaagaaacataggacgtaatctgcactatcaaataaatggacctagtagatatttacagaacatttcacccaatggctacagaatacatattcttttctttagcacatggatttttcttaaggatagaccatatgttaagtcacaaaacaagtcttaaaattttcagaaacattgaaataatatcaagcatcttctctgactccagtggaataaaattagaaattaataatgaggggaattttggaaattatataaacacatggaaattaaacaatatgctcccaaatgaccagttggaaaatgaagaaattaagaagaaaactgaaaaatgtcttgaaacaagtaataatggaaacacaatgtgccaaacctatggaatacagtgaaagtggtactaagagggaagtttatagccataagtgcctgcatgaaaaaagaagaaaaagttcaaataaacaacctaatgatgcatcttaaataactgtaaaaacaagagaaagtaatctgaaaattagtagaatttaaaaatgaagatcagagcagaaataaatgaagttgaaataaaacaattaagaagatcaataaaataaaaagttgcttttttaaaaagataaacaaaattggcaaagctttagccacactaagaaaaaggagaaggcccaaataaataaaatgagatgaaaaaggaaacttttaactgatactgcagaaatggaaaggatcaccagtggctactatgagcaactatataccaactaattggaaaatctaaatgaaattgacaaattcctagacagatgcaatctacaagattgaatcagaaagaaatctaaaacctgaacaaaacaataacaagtaataaaatcaaagtcataatagaaagtctccaagcaaagaaaagcccaggacctgattacctcactgctgaattctaccaaacatttaagtaactaataccaatcttactcaaaatattttgaaaaatagaggaggagggaatacttctaaactcattctatgaggccaaattgccctgatactaaaaccagacaaagacaccacaaaaaaagaaaactataaaccaatatcactgataaatattgaagcaaaaatcctcagcaaaatactagcaaactgaattcaacaacacattaagaagatcattcatcacgacctagtgggatttatcccagggatgcaagggtggtccaacataaggaaatcaatcaatgtgatacatcatatcaacagaatgaaggacaaaaagcatgggatcattttcattgatgctgaaaaagcatttgacaaaattcaacattccttcatgataaaaatttccagaaaactgggtatagaaggagcatacttctacataacaaaagccatgtatgacagacccacagctagtattatattgaatgggacaaaactgaaagcctttcctttaagatctggaacatgacagggatgcctactgttaccactgttattcaacatagtactggaagctctagctacataatcagacaagagaaaaagggcattcagattggaaaggaagaagtccaattatccttatttgcaaatgatatgatcttatatttgcagaaaactaaagactccattaaaaaacctattagaactaataaacaaactcagtaaagttgcaggatacacaatcaacatacaaaagccagtagcactttatatagaagcaaacaatctgaaaaagaaatcaagaaggtaatcccatttaaaatacctacaaataaaataaaatacttaggaattaatttaaccaaagcagtgaaagatctctacaatgaaaactataaaacattgatgcaagaaattaaagagaacacacaagaaatggaaagatgttccatgtttatgaattggaaaaatcaatactgttaaaatgtccatactacccaaagcaatctacagatttaatgcaatctctatcaaaataccattgacattcttcagagaaatggaaaaaaaaaatcctaaaatttatatggaacaacaaaagacccagaacagctaaagttatcctaagcaaaaagaacacaactggagaaatcacattacctgacttcaaattatattgcagagctatagtaaccaaaatagcatggcaccggcataaaagtcaacatacaaaccggtggaacagaatagagaacacagaaagaaacccacatatctacagtgaactcttttttgccatttcccaagaacatacactgggggaaaggacagtgtcttcaataaatggtgctgggaaaattagacatccacatacaaaagaatgagactagaaccctatctctcaccatatacaaacatcaaatcaaaatggattaaaaacttaaatctaaaacctcaaaccataaaactactaagagaaaacattggagaaactctccaggaccttgaacggggcaaatatttcttcagtaatattccataagcacaggcaaccaaagcaaaaatgggcaaatgggatcacatcaagttaaaatgcctctgtacagtaaaggaaacaatcaataaagtgaagagacaatccatagaatggaagaaggtgtttgcaaattactcatctgacaagggattaatagctagaatatataaaaagctaaaacaactctataggaaaacgtctaacactctgattaaaaatggggaaaagatttgaatagacattttaagacatacaaatggcaaacaggtatatggaaaggtgctcaacatattgatcatcagagaaatgcaaatcaaaactacaatgagatattatctaatctcagttaaaatggcttttatccaaaagacaggcaataacaaatgctagtgagaatgcagagaagagggaatcctcatacactgttggtgggaatgtaaattagtagaaccactatggaaaacagttttgaggatcataaaaaaactaaaaatagagctaccatatggtccaccaattccacacctaggtatatacccaaaagaaagaaaatcagtatatcaaagagatacctgcactcccacatttattgcagcactgttcacaatagccaagatttggaagcaacctaagtgtccgtcgatagatgagtggataaagaaaatgtggtacatgtatacaatggaatactactcagccgtaaagaagaatgagatctagtcatttgacaacatgagtggaaatggaggtcattatgttaagtgaaataccctaggcatagaaagacaaacatattctcacttatttgtgggagctaaaaattaaacgattaaattcatggagattgagagtagaaggatggttacagaggctgggaagggtagtgggggcggtggggaggaagtgaggatggtcagtgtgtccaaagaagaagttagaaggatgaataagacctagtatttgctagcaatatagggtgactatagtaaaaaataatttaattgtacatttaaaaatagttgagtataattggattgttcctaacacaaaagataaatgcttctcgtgatggatacaccatttaccctgctgtgattattactgattgcatggttgtatcaaaatatctcatgtaacccataaatatatacacttactatataacaacaaaaattaaaaataaaaacatttttaaaatgtgatacagtgtggaaactaaataaatatgaaaaattttagatggtaaaaccgcagtaaagtaggattgctttcacatattgttggtggcagcctaaatttttataaccattttagaaagcaatttggcaatataaggtaaaagtctctatattctttaaatcagtaaatgtagtgcagaacaagctaaaatatattctcaggaaataaattgtaaattatgattaactcaatatagcatccattaaaattataattttacgattctagaaatagtgtaaagttataagtggaaaatcatggatattaaattacatatacaaggtcattgctactaggtaaaattggtttgttcatttgaaatatgatatataaaatgtacaaaaatgttagcagtattttgaaagagtgattatacctgagtatttttgcaattattcaaattttgttattggttatatgtggtttttatgattttttttaaagaaaagtgctcctggttccagctaaatggacctggggtcattggttttctttcccctttgccttttcacttgataactctcaggttttctaacttgtctttttattttctccaggattaatttatctaaaatatgttgttaccaaggacagtgcattattaagttattgctgcaataatactgctgatcaaatcactctgatctcagtggtcgacactgaagaacattaatttttggagtgggggctccaagttctgcagaccaattagggcaactctaattgaggatgcaggttgccagggcttgactctggggtctaggctgcagggctgacccattcgtctcatttgggggctaaagctccatggaggtagctactgaggcatgctcttctcatatacctttgctgaatttctattggttggatgaagttatgggactaaagccaacatcaatgggaaggagaaatatatctcacccactctgtgattccacaaagtcacatggcagagggaaggagcaaagaattaacaataatacggtctaccataagtaggttaactgtcatctgtatatttcacaatctccatctataagtaaaagatgtttggttatataatctcatcagcgagttatttaacctaagcctcaatttcctccttaagtatggatgatgatagtatctgtttatggaatgcaatgggattaaattagataatgcttgcaaaacactcaacataatgttcaacatgctatctgttattaatcttcaagtctcatgcagctgtgtgagacatctatgatatttcacggtctacaataaactctagtataaatagagacacagggaaaagacaagaaaaatctctctccactttacttcacattctctatggggcctccaaaggctaatggagattcatttcaggtctctatgtcatctggatcaccccttgagggcttatgtataaacactgaggccaggtcatccttggttttcaggactctgcactattagagatggttttaagatgacttgagtaacaagtttgctctgtgcaagaactgagaatctaattcaagttaaggaagatttacaatctttacttaggttccaagtaaatctaactacctctaagaagttgcagtcgccaaagggattcagaatagtctctgagagttaagtacctctgggccacccagatctcgtgccctgggaagcaggataccctggcccatcaaactgacaaagtactcggccatgggatggtcacacctttgttatgttcagatttttttcttgtctattcaccttatattacctaaagatagcatagtcatcaacatataagccctataaagattaatattagacaaaattaaaattatcattaatgtaaaatttctaaaacattatcaatatattattttaatgcttgcccttcattttagcagaagtattgaggtaatttttctattctgcttacctttttgtggaaatgctgtgaagatacattgataaaaatattaagtattttattatgtgatgtcatgtgttattttgctttaaggagaccagtctcaacttctgatttcccataaaattattatgggaaatgtattaggtagcactgcttcttatatgtatggcatttattagaaactggtagcataaatcttaagaataaggaaaaaagagagaattaaaaagacagagagaaagaaagagagagaggaaagaaggaaggaaaagaaaagatgagggaaaggcaggaaataacttgccaaaaggaagcatgtttgaaactaatatagcaaggacattagactatgcgttattttgaatttagttatcaccttttctagttttctttatatttttatatgttcaatattaaacatccaccaaattccatttacctgcattatcaaagaattaaaaaagcatactttatcatgcacctagctctccttttgttcagttgaaactctggattaaactcattgaagagtctttgaaaatatgaaataatctgtttatttataacctttaattaaggaaatatccattaccatgtttccagttgacaagaataatgtcttggtcatttcgtgatttattattttttaagtacttttcagataacttgttcagaatagggtagaaaaagtcatgtatttgaatcatgtgtctcactctgcgattcaggtacaggcctaaaactcccggggctttcatcaacatcgcatttcacaggatgccacactaagccacatgcacagacacgctccatttgcttcttccattccagtgacatggtgcagttctcctgccttctgttaggctgggttctccgtggagtgctggcctgagtgaataccggaaagaagctactccctgaaaaacgcctttgtctccttcagggattccttctcgttacttggggtggcccccttgcatcttccctggaaagatcctgccggtcaggagccaggccttggtctgttgccgaccattctccttccctcttatctcaattctgataggcctttttctgttacccacatctttaccttctctccagccttcaatattgtatacctctctgagttctctcctagtgtattaaaaacactgagcttccctcacatgcacaaaacaaacaaaaaccctatttgctatcaggagcagcgattcctcattacaagaaatgtctgagttccacgaggcgtgatcttcttctgaatcttctggcctcgctcatgcaatcacctgcctcctctaaaaacctccttgcctttaaaactatgcatccccacacaagtttccaaagaacctttcttaaattcaaagtatttttctccttgttttataaaacgtcctcccaggttatgtgactttaacatcattaactaacttccctgtgccttgctaggtttcctcacataaagataaataataccttcctcataaagtaacagtgaggattaaataataatgtgtgaaaggtgctcagtacgactccagattctacggaaaagatcaaggaaagatggctattgttggcttttattgttaatacctcacagcccataggcttcaaaaccaatgctatcttatttgatattttaattatttgctgtttttggttatcttcttatttgattttttaattatttgctgtttttggtcatcttctttggtcatctttggactctcccaaaggtgacagtcctcccacgtgccagtgctcaagtcctactccaaaataagttggctttctctgaggcttaacacttcccagtccagagatataattcagcaaactactcaaacttgaaaataactttaaaatcccaccctaattcaagctgccaccatttctcatctggtgtcccaaagcttcctgactcatctccacatgtcacgctgctgcagcacatccaaacccactcctacacactgtgctgctggagaccgtcactgtgcatggaaaggtccaaatcccaactccctaacttcaccttcctgatttcacatgtcctgtcctctgcttacctccccactgtcccttcagccactcttcctttgtctttatcttctcttacctcacagtttctctcatctcctcccaattaccttttgccctttttaatcttcttttttaggaaaattcatacaatacaatgtaaactctaccaggatgtttttcctctcaaacttccctcctcccttcctgcttcctcagcctacctgaccgtaggtaacattcaaagtgcagctcaatggccaggcacggtcgctcatgcctgtaatcccagccctttgggaagcttaggctggtggatcacctgaggtcaggagttcaagaccagcctggccactatggagaaaccctgtctctactaaaaatacaaaaaaaaaaaaaaaaagctggatatggtggtggatgcacgtaatctcagctactcaggaggctgaggcaggagaatcgcttgaacccaggaggtagaggttgcagtgagccaagatcacgccattgcactccagcctgggtgacaagagtgagactccttctcaaaaaaaaaaaaaaaaggaaaaagtgcacctcaaggattgcttccttacaaaagacttcccttaaccctccaactaaatcagaagcctctgtaacatcctctcatccgtctagagatcatttctttcatgacccttctccagactttaccttttgtttatttatttgtttgattcttgcatatgctcgcttgtccttgctagaacatatatgttcagtgagggaaggatcctttctgccttgtttattgctgtatctcagaatctagaagaatggggcatagaatagtaaagtttctatttaaaaaagagcaagaattgcacgtcctttaaaatattttcaataaatatttttaaaaagtcatttaatgaatttcattgaattgtgttcatgggacaattaaattgtctccctcacttgacagtaattccaaaggcttatggaaaccttctgctggtcgactgttgcaggtggagcctacacagtgcacggcgcgacggttggggctcctttaatattagatcaatcaacatgcatctttagggtgcccccactgtgcctgcgtgagaacgtgaaacgttactgcttcctcagccttctttcttccacacctctgagtggcaccctgaggaggaagtgctcatgacttccgtagtgaaggctgttctctctgaagatgtcactggggaaattttatcctttctaaatttagaaagtgggggagagaaatgcagctaaatggttcagattcagagggagatagtgagaaccctgaaaatgaatcatggtacttttcacacacatagtgaatcaaaatttaatggcagtgaaaggctgttgataacattcctttaaaaaatccacataaccaaagacatttacttgcagaaaacttcctggacttctaagtagaatactaggcaggtctgtatttttaaatttagaaaccagtcacagattttttttctctaaacttcattaagagctgtgctctgtatcagctggtaagcctctaatcctacaaaggttgcttatcaggtttggggaaaaaatattttaaagggaatacaattcttgctctttcttaaatagaaattttactattctatattacattgtcgtataacatgtcatttggtgcccctggaatctcctgtaaaatagaagcgtacgctagtaaatgtcatgatgaaatgaaaccagggattatgaaagttgtgaagctttcattaaatataaaatcttatattcggtaccttagaatcagtgactctaatacgttatttttaaaatttattgtcaatattagccgtgtccccaaattaagaaactgcactgagcgtttacggcattgacttaagagaaatacagtcaacgtattttaaatatattaccatctgtacccaaatataaaatgatctttaaatgtaaggtagttccccattttatcacaaactgttttgatcaacttgaaatagaagcccttaaatgaaagtgtcaaatgtcaatttacaatattaatcatttcagttacccagacatttaaaattacatattctggtacagcactgtttagggaactttctgtgatgacagaaatgttccacatttactctaatacgggagccaccggtcacatacggctagtgggcatgtgtgcccacttgaaacacggctagtacaaccgaggaactgaatttgtaaattaatttaatcttaactaatttaagtttaaattggttggtgtggctagtggctactgaaccagataacacagctctagaaaactaaagatttttttagaaatgttgctattttctactctcattcaaactccacacgcttcattgacaacactattgtcatcatcataacaatgatgttagatatgttatttaatttttcacagcacataatttttacttctaagttgattgaaaatacaaaaaaaattagaaaaatgttatgtgaaaaggaatatagaataagaaaaatgtgccctgatactcatggggccagattagcccttgtgtaaaaagagtttgaggagaggaggcacaaatcaagagatccgggccctgttctctttgaagaagattctacttagatgttcgggtttagcactttgttcttctaagttctcagaaaccaaagaatttgtgtagaaatggtaattttacctgatgtattacccaagaggcctcttaaggacaagggtagccctcttttatgaaggcaatttttgagaaaaaaagccattgctttatatatggtacatatggtaagtaagaacaattgaagaagaactgaacaccacttatttaaaaattgtgtactttatttacaaccacatgaaatattttccaatcaccaagccatctttagaagttttccttccttaatcatcaaaatgtcagtacaagaagtttggatttagttgtgagtgactgggtgctgtaaagtccaccaagtagtggcatcatagagcaccaggtggctccctaaacagtgagacctgggcacaggtgtcaatccccagagattctgtcatctaagtcatgaggtcatctaagtcatgagcatccacatggaacatacagctatgcagttactggcaaataaaacaaaataccgactgtgtctcctacagtgagatcaaagaaccactctccacttactctgcaaacttgccttggtaccatctccttccgagattcaataattgatgtttaatatgtgctatttagttctgctttattattaagaattccttgaatgagatgaatgaaaagaatattaatctacttcaatctagaaaaaaaaatcctcatatccataaaatgaaattaatgatttccagaagcaaataatttctgtgatgatgttctcagaagaattaaggtgctatctggtgccctgcttggatcgttagcctaatgggactgatcaatcagaaggataatggctagatggatatttttgttgttttatttttaatgaataagagatacttatattcattaaaattagaaaaaagataatgaatcacctcaaattacagaatttccatatttcccaaaaaactgacagtgtgtctgccaataatagccacatacaatatttatgcaagcctggctttctgtaatgagaaattcaacaattgccatggtgatatcttgggaggcaaggaggaaatactggtgataacgggagtcttgagtggtgatggcgggcagcatcataccatcccccttgggcctgggatgctgccaaggtctgcagcgtgatgtttgtcctcctccatcgtcatccaaacaaacaggaaacttgctctacagaaagtaattcttgctgtttttctttatacatttctcaaaatatcttttaaatactttgttacagtaggtagtcaggcctacatgagcagggcaagagagcccttccatcccaacagaaatgtcaggttaccattagatgatggtcaggcagttgttaaactgtctctctaaaaaaataattggttacagccagtgccgtggaaaggcagtctcccagcagatagaaacacctgaaactggtgatcagcttcccagtaaggtctcaggagttgcgcaagtgggctcaagcatgcgcattaagaggcaaaatggcggagtttaactggtagatgaccttgcacggacatttgactggtacgggaagaacgcttcaaatgagcatacatacagctccggtaaacacactgcacgtgtggcacctccaagagcgggcaggcaactgcacaggcagacagcccaccccaagggcagaatcagggaagaagagacgcaggaccccggaagcatgccaacgtcacaccgcgcacttcatccctcaagtcacccgcgtggccctcttgcgagtgagctttgcttcctttcgttcctgctctgaagctttttaatgaactttcactcctgctccaaaacttgcctcggtttctgtgtcttacgcgcctcagtcgtattctttcttctgaggaggctagggctgaggttgccgcagacctgccccgattcgccgctgctaagaatttctcagactccaagtttccagtcttccctgagcagctctctgtgacttttttcttcctgcgctgtctcgcactttacacacagttttctctgaggaaccttcctcctactaaatgttctaagttagttttccatgattttttttctcctccttcttcccttgactgttgggatacagaaatatttcacacaaatgatttctaatacgattgagtaggaaggaaatcagcttactttaaaagtctagaagcattcttaagtctgcttttcaataatcgtcttttttcatataatacttttcttgccctctttggaaactttgagcctgaatacaaattagaacaacacaaaattcaagtccttatgatggaattcaaatttgtattttggctcaattagctgctttctagtacatttaggatcatagcatttagcccacatttagtggcaaaggtagtaacattaacgttgggttaagtacaaaacattaaccaaaaaatcttgtagagaattgagatgttatgactagaaagaaattatgaagatgttattttcagggtatacatggactttaactgggcactgatttttatcaagaagtattagcaattaaattaactgtctttcatgtgtttaagaaatcagtcttctatccatattatatgagacaagaacatgacaaaatattttaaaaagcaaaagaatgattataaaaaataatgcagaaataatatttttaaagaaaatatatttaaaatgcagttttgggatattttacagcaagttacttcaaccatacctctagttatacagaattttgtcaagaaacaaatcatattttaacatatctagtttgaagttttccaaatacaaataaataaggcatcttaaaagcatgacaatttattctgtcattacttaaagcttttaattttgcatacttagggctagtaaagatataataagaaatagattggaagcagctgaacaaacatagtgttcataaatgcatttgatttgatattgacgtcaagcagttctaccaaagtgatttaagaacttgagagataagctaatacggtggtctaaagggagtcttatcttgttctgtacatatgagttcagagctctctattgaattctactttttaccacatctgattattcttcacggaccactgggaatagaccaaattggggccactgatcctaatttaagtcctttctgacccctttctgagtcttcaattcttgcttgcaaaagagagtattcaaaatgtccgtatcaaaataatatttagataaaaggtgtgaataattcatgataaaaaatttgctttctgattatgtaggttattatattaactaaacatgtttattttaccttttgatgtggctctgttctgttagccctaccacaaagatgatatttgtcacagtgtaacagtctattatattacctcttacaaaggcatgatattctattgatgtttaatagaataatttttaaagtacaaataaatgatttaatttatttaaataatttatattaaatattaaaatgtatatatatcacagatattttatatgtatattacctatattcaggcatgcagttagggaaagaaacggagggaaattgttagttaaacatgatcttaagaatttcttccatatgtggaaaagtcatcagttcatctggcatatagcaatatatacatatatatatacatatatatagaatgctatgtatacatttatcctacattcatttaacatcaaaacataaaaaagttatttctttattctctctaagcaaaaaccagtaataacagctctgtaaatagactctagaccaacagatcaagggaacaggttaaaccccttgcttatttgttagaattcaaagagcctcactttagctaatctgattgggctaatttgtgtgtaaatacagatatggatagatagaactatatatatatatacaaacaatatatattttatgtaatataaaatacatataatagataaattagaatctattcatttaacttacctgaaaccatataatcactcaaatgtgtctgcatgtctgtgtgtatctgtgtatgcatgtgtatgaaatgtagttttttaacttgacatataatagatgtaaatattttcggggtacatgcgataatgtgttacattcgtataatcaaataaggataattggaatatccatcatcttaaatattcatctttatgttagaaacactaaagttattatcttctagctgttttgaagtgtacaatagattaatgttaactatagctatcctactgatacatcaaatactaggtcttatttcttctgttataatgcatattcgtacccattaatcaacctctctttagctcccctttcccccaacccttggtagcctctggtaatcaccaatctactttttatcttcatgatatctttttagctcccacatatgagtgacagcattcaatatttgtcttgctgtgcttggcttatttcacttaacataatggcatccagttctattcatgttactgcaaatgacagaacttcattctgttttatggatgaataatactccattgtgtgtgtgtgtgtgtgtgtgtgtgtgtgtatcacattttctttatccattcatccaatgatggacacttaggttgattccatatcttggctattgtgaatagtggtgcagtaaatacaggagtgcagatgtctcttcgatatactaatttcctttcttttgagtatatacccagtagtggcattgctggatcatatggtagttctatttttagtttgtttaggaacctccatactgttctccatagtggtgttattaatttacatttccacgaacagcatatgggggttcccctttctccacatcctcaccaacatttattattacctgtctttttgataaaagttattttagctagagtaactccttgtagttttgatttgcaattctctgacggtgagtgatgttgagtattttttcatatacctgttgatcatttgcatgtcttgttttaagaaatgtctattcagatcttttgcccattttaaaaatcagattatttattttcttgctattgagttgtttgagctcctatattctggttattaattcctgtcagattgatagtttgtaaatattttctcccactctgtgggttgtctcttcgctttttttattgtttcctttgccgtgcagaagtttttagcttaatgttatctgatttgtctatttttgctttggttgcctgtgttttttgaaatcttacacacaaagtatttttccagacctatgttctgtagcatttccccatgtttttctcagtagttatatggtttcagatattaaatttaagtcttcaatccattttaatttgatttttgcatatggcaagggctaagagtctagtttcgttcttctgcgtatggatatccagttttcccaggtccgtttattgaaaagactcatctttccccattgtgtcttcttggcaccattgtcaaaaatgggttggctgtaaatatgtggatttatatttgggttctctattctgttctgttgatctatatgtctgcttttatgccagtattacactgatttggttactacaactttgtggtatattttgaagtcaaattgtgtgatgccttcagtttcgttcttttgtagttccatataaattttaggatagttttttctagttttttgaagagtgtcattggtattttcatgggggttccattgaatctacattttagggtagtgttgtcattttatcaatactaattctttcagtgcaaaagcatgacatatcctttcattattttgtgtcctctgcagtgtcttttatcagcgtttgatagttttccttgtacagatctttcatatctttggttaagttgattcctaggtattttatattcttcttagctattgtaaatgggattagtttcttgatttcttttctagattgtttgctgttgccacatctaaatgctacttattttggaatgctgatttttatatcctgcaacttgtaatggagttttggtggttatgactatgcatgtctttgaactgatttggtagttgaaagacatatatttttaaaacttcaaaaattagagaattgatatgggtagatatttaaactctacttcattaattcatctcattttatgaatgtgataagatactagaaagcaagtggcttccaaggggcaaaaactaataaattacagagacaagactttagcctaacttgtttaacttacaataaagtggtacttctctacctcacttagaataaagcagtattgtatctcctccaaagtctgtggtgaaacttaattctcagcacaactgtatcaaaaggctggcccttaggaaataatcagaccatgaggcctctgccctcatgaagaaagggctggagagaactaactagccctcttttgtacttttttgcctttccctcccttctggcatgtgaatatacagtgtttgctcctctggagaatgcaacatataaggcgccatcctgggagcaaagacagggccctcactagaccctgaacctgccagccccttgatcttggacttctctgttttcagaactatgagaaatcaatttccattgtttataaattactcactctgtggtatttttttataacaacacaaaaaaactaagacaaattggtaccaccagaaatgggtgttgctataaaaatacctcaaaatgtgaaagtgcctttgaaactgagtaatgggtagagcctggaagaatttggaggtgcatgctagaaaaagattagattgccatgaacagtgcattaagggtgattctgatgggagttcagaagagaagagctgtagacagagcctcaatcttcttagatattacatacatggtcatggtgagaatgctggtagaaatatggacagtaaggctattcttagttctcttatttggagatgaggaatgtcttatgggaaactggaagaaaagcatcctagttataaatggcaaagaacatggctgaattgtgtctgtgtcctagtgttttatgaaaggcacaacttagaagtgataagctgggacatttcgtgaacgaaatatctaacaaagcattgaggttgtcgtatagcttctcttgactgcttatagtaaagtgcaagaaaagagaaacctgaaatatgatcagagctgaaatctataatcaaaagggaaacagaacttaaagatttgaaaattttgggcacagccagatggtaaaaaataaaaaagcatgtttgggagaaaacaccaagggtgtggctaagggagcatttggtaaagaggttggtatgggtagaagaaggccaggcactattcatcagaacaatgaaataatcaccccaaagcatttctgaattctttgtggctgccctactcatcataggcccagcatgccagggccttgagggttgaactgtttcgaaagaagggcccagtgtggccttactgactgggattgcctcaagtctatgttccttgcatttcagtgcagtgctccttggtcaccccagcgtggctcaagtgggcccaggtgtggctcaggctgttgcctcagagggcacaagcagtgaatggtgacatctccatggtgctaagtctacaagcacacagattgcaagagccatggaggcatggatacctctacctagatttcaaagaatggctcagacagctgtggggcccagtgttttaaacttcaaaggctacagtttaaaacactacactcacaggcaggcccactgcagacagccccccatgagggcaatgcccagcacagccatagagtcaaggccaccatagagagctcccattagggcaatgtctggtggagctgtggggatggggtcatctccaagacaccataactgtagaggcaccagtaaagcaacgccagcctgcgagagctgcaggcacctgactccatcccctgaaagctgctgtgtgggctacaccaagcaaatcagtggaggtggggtcccccagtgacttggaggtccaaactctgttctaatgtgtccagcgggcagggcatagagtcaaagattgaatattgtttgacttgttgcattttggacttgcttaggattgtgttttgggagcatacaactgtttaatgttacaggctcacagttgaagagcaaattgagtctcacccatatctgatctagttgagatttgaatttagactttaaggttgaatctggcatgagttaagactttggggttattgggatgaaattcatgtgttttttacataagaaggacacaaatttgaggggagggtcaagagcagaatgcaacaggttaaatgtttgtgtctcctctaaaattcatatcaaaacttaatccccaaagcaactatattaagaattaggtcctttaggaggtgattaacctaagagggctccactctcatgaattagtgacctcatacaaaagctgaagataactagctaggcctatttttgcctttttgccttttgccttttgccttgtgagtacacagcactggaggtgccatcctcgaaacagaaaccaggaccaaaccaaacaccaaacctgctggtgccttgaacttgaacttcccagcctccagaacagtgagaaataaatttctgttgcttagaagttatccagtccaggtatttcattatagtagaacaaatggattaagacacactgtaatgcactgcttcataaatggcattatattatcctattaattttgttgttaattttgctctttaaagaaatgataaaattggggccaggctcagtggctcacgcctgtaatcccagcactttggaaggccaaggcgggtggatcatgaagtcaggagattgagaccatcctagctaacacggtgaaactccatctctactaaaaatataaaaaattagctgggcgtggtggcacacgcttgtagtcccagctactcaggaagctgaggcaggagaatcgcttgaacctgggaggtggaggttgcagtgagccgagatcgcaccactgcactccagcctcagcgacagagtctcaaaaaaaaaaaaaagataaaattagtaggaaaaatcattttaatgaacatgtgatcttggaaatttgctctgaagccctcatatggcagcaatattaaagcagattaaatactaagatacgtgtgtgcgtctgaaattatttttacataaactggtttctctaactttactcaagattattttaactaattttaggcagagtaataccctagtttgaaaatatttttaggcaaggaaattgcaagcccccgtttggcaatatgctctaacacagggcttctcaaccctcactatccatgaacccccagctaaaccacaacatgcatgagcacacacacacacacacacacacatgcacatacaagtcctccaaatcaacatgagaaaagtctctcacataattcaagaatgctgtttcaccaacttcaaccctcagtctgacaacaagatgtaatagtaaatgtagtatatccgtttgaagcactttataaactgaaagaaactggacacaaataaaatggttcaaccatctcttcgataatttttatagccatggaaagacacctcatagtcacataatcttaagcgtgttcatggagcagcgagtcaaatgacattatgtggcaataaagaagacttcagcgcgtttcctgactttaccagtgaaaacatctgaccttgaggagggcactgaaaatgccactgcatcgacattttttttttttttagatggagttttgctcttgttgcgcaggctggagtgcaatggcacgatctaggctcgctgcaacctccaccttccgggttcaagcaattctcccgcctcagcctccgaagtagctgggattacaggcatgcgccaccacacctggttaattttttgtatttagtggagacagggtttcaccatgttggtcaggctagtctcaatctcctgacaggtaatccacccgccttggcctcccaaagtgctgggattacaggcgtgagccacagcgcccggccgcatcgcatctatttttgtaaaatatgcataattctagaatatgtttgttgtgaggattgaagctcataatatgtacccttttaaaactttatgttgaaatgcctcaaatcaaaatattatcatatgatgcagtttattcatccttatgagaagacacctgatagggactgtcaagggtgactgtatcaaatgtgcaagagattcggggcatttgcttattgcagtgaattgcacaaaagaattatttgaaataaatataacatgcaatgaagttgtcaataagtagcataatttatacttgctagttcaatgctggacacagataaagtgtttcaaaatacaaatgcctcacagagaaaagggaagtgaatgagaagaaaggaaatttattgaaatgaaagataggagaaaacaggagaagcacagaagtgacagacaggaacctattgcacatgagaatgacacttcactagacagaccctttcagaattcaatcacaatgctaaactttccaaaagttcacaaagtaaaacttttgagtactagcagtgacacaggtcctgttgaaattttcacaggaaatagagggaacataaactgattagtttttaatcaagataaacacatatgtccactctaacttagtaatcgcttatgtttaacatgttaaatacaatgtattaaacttattatatgctaggcactgttttaagtgtttaatatctgtggtctcatttattgctgctaactgcctaagaaaataggtaatatccctactttagctttgtggaaacagatgttcaaagctattagtctcccatcatagcaagtagctgagccaagatgcacacgtggtccctacagtttaaaacactacactcacttttctcttctgtactattgaagtgatgctgtcattattcactattcatttaatgtcttttgcacttgttttaagatcagttcaggagtatttcagttcaagtcccaccatgaaaagagaagccacaccagcattttagtagagagaattgtttccaaggttattgtagacccgaaaaggcaaaaagggagacagaggatggttagcttacatctccaggactggaacaaaggaaaaagaatgggcttatcaccacctacaacctcagaaactaggcccagcagagctgtgacccagacacctgagaagtgggcttttctttggaggagtcagggagagaccccacagagctgggattcagatttctgaggggcggtgctacctcattgctgcttgttatctccaagctggagatgataggaatggttctgggagtgtggaagaaaaggtatgtcaactactaaaccgaatgctgccgtggctgtattgacttgagtgcttcccttctctccgcctgctgtcttcctgtctcccactagtgacttgtagctgcagaagcagacggcaaacagtcctacagtttccaacccagcaccactgagcagatatataaaggtagatttgagctatgcaagtcagtcagttccattattttataattaagccatactttttgtttaattactatatactcaatttatcagatttgattaaataacctctgagtattgtcaaaagataaatccacttcccaaagataaggatttgccaccatggaggatatcccaatttcagactacatctattttccaggcaaagtttcaaattattttcctcaggagacatcaaaagatgtcttcagagaaaagacctgctgatactggcgttaggggttacataaagaaaagggccagctccttcctgagttccctggagtgagttccagaaaacaacccagagtttccaatcagcgtcttagtgtccaaggaccagccgataatgtgagaaaatatcccatgatgaaagagtaagtcagtaataaagcaaaatgtggggacagaaagataattcaggaagtagaaaactgaaaaaatgagtataaattatcagaaaaataaaaacaaactattgataacaacaggaatgccatgaaaaatgaacaattagaaaacagtgacaactagaacaataaaaaagtctttgaaaattaaaaaaaaaatgatggtcaaaataaaacttctaatacaagaggaaaagtttcagaaatctatcaaaaaataacaaggaaaaatacaagacatggagaatcattgcaagaaactcactttctagaaaaaatggcatgagagtggggagacagaaaaaaacgctggagaaaaagttataaaagcactaatacaggaaaatttccccaaactaaaagacttgagtcctcaaaatcctttttaatggccaggatgaaaaatgaaaatgtcttatttaaggcatataaaattaaaaagcatcagcactaaagagaagcatctaaaattttccataaaaaccgtaaatcacatacaaaagaatgagaatctgaatagtgctgaaggatcaacagaagcctttttttttttttttttttttttttttttttttgctaaaagtcaatggaacaacaaggcctgataaattttaaagaaaaaataatgttcaaccttgaaattttgttaatactttattctacaggtgtactgcttttaatacacacttcctttaaaaatttccttgctacggcaaggaaaacagaaagtaactaagaaaacgggagtcagttctagaatatggtatatccaagttaggaaattaggaacacagccacagataacagcacacagctaaagccgagagcagccagtccagatcacagcaagtgaaaagagactccaaaaagttttttctagttaagagaaagactcagtagaaaagtagttgatatttagaatcatagccaagaagaattaagaagagtaagtaagaaaagaattaaggatgtgagaatgaattatacaagtgaaagaacaggtgcatctccttcaaaacaaatatctacacagtataaaaggagtaaacatagcatgctagctggcccagcagtgaacaatattttcatcacgtagtggtgtaaatacagcttgctaatctacattaaaaataatatgattctattgtgataattctattgcaagaacgagggaggggcaaataagagaactaagtctatatccatcatcatagaaaatcaatatgtaatatttcaacatgcaaaatcaataaatagcaatatagatttcatgtttagaaatagggataaaactacagaagaaaaagctgaaagagtgaagtgtctgcctctgtagggtggtactacaagaaaaaagaactgcaaggtgctattgtgtactgtggtaagttttcagtatggggctgtttatttatatgtttgatctaaaaatcgtccccccccctccgtggctctgccctgcgtgggcggactgcgaggacctgatctctgcaaactacacttcccaggattccttgtgcattgactgctggctcgtttcagccaatgagaggcactggcagaaagtcagttgtcctggtatatgctggcatatctccgcttctctctcttctgtggtgccacctctggccactgatattctcctcacaaggcacaaggtccccctgcctagtgaggcctccaaagttctacttcaggcttggcggctccaactcttaagctactctctttgaacctccaacctagggacaagggcaacttccagcagcaaggaatctcatcttccgctggtggctccttaaggtcttataacacctttaaaaatagcgtcctaggccgggcacggtggctcatgcctgtaatcccagcactttgggaggccgaggtggacggatcacgaggtcaggagttcgagaccaccctggccaggatggtgaaaccccatctctactaaaaatacaaaaattagctgggcgtggtggcgggcacctataatcctagctacttgggaggctgaggcaagagaatcgtttgaacccgagaggcggagcttgcagtgagccgagatcctgccactgcactccagcctgggcgacagagcgagactccgtctaaaaaaaaagaaaaagaaaaagtgtcctatattaaataaattcctcatattttatactaatattaattccaattcaatactttacatcagctttgatttttcaaatggccctgagtgatacaagtaactgtgtagtattttaatatacaagtgtcagaaagtattgacagagcctctcgaccaaactttactctcttcaacgatttctcaacttttagactttttttacttatctctacattgtccaaatttagcaagaagcttgctaagtcaatttagtcattctccttgtctgctcaccctggatatctgatcgggttcctcatcctccaccatcctccagatgatgtgtgattgccctggcctgcctccagccagcatcctggcaggtcagtttggccacagaatctcccttactactaatgtttcctcttagtaattttccgtccaccgagctccctcccctgctccttgtttataaattctcactttttcttatttttttcagaactgagcccaatctctctcccccactgcaaggcgccattgcagtagtcctggatctatgacaaaagtaccctcttgaacaaagtctcccttactgtttttaacaagtttcattaatacttttttcttaaacagtataagtttctaaaaggtcaaatatatatttcatagtgctttgtgaattcttaaggaaaaaaatcagaacaatggcagaatcacttcaaaagaaaaggcgtggtggctcgcgcctgtaatcccagcactttgggaggccgaggcagcaggatcatctgaggtcaggagttcaagaccagcctggccaacatggtgaaaccccatctctactaaaaatacaaaaattagctgggcatagtggcgcatgtctgtaatcccagctactcgtgagactaagcggggagaatcgcttgaacccgggaggcagaggttgcagtgagccgacattgtgccgttgcactccagcctgtgcgatggagcaagactctgtctcaaaaaaaaaaaaaaaaaaaaccaaaaaaaaaaaaccaaaaaaaaaaaaaacagagagagagtgagagagagatcttatattctcctaaagtgtctacttggaatgaaattctcaggagttcacttatggctagttaaagccattgcattgttctacaatactgcaaaatgaaataagtaaaatattttgtccccaaataaaagagtacagcttactttttctaagaattaatattcatgaaaactacacttgtgtttttattttgtccccagtgaaaatcagcgtctcagcagcagatccactgaatatatcggtacaacttgatagatcactgcttcttcctacgagacttcagcgtcaaactaaagggaaaaacccagcagttttcttattattatcatgtatttaattacataaataatatttttaaaacagtccagaagagcacataatgaaaaccatgtctctctcattcgagtgtgctctctgtgggcagccagtgtccacgtctcctgtacccttccataatccatttatgtagttataagcatgcatttacattttcccagaaaacggggataataacatcattaactgaagtaaaatttttgtaaggattaaataagaagagaaggaaacaaaaatttaatatattaagtccttaataaatgataaatatcagttattcatattttctaatttcatcaaactatctactatcaagtatggaaataaatttatctggtctcctactgaggttgttttccaagcttccaagtttccaaagtttatataagtataagtattgtataagtattataagtgtatgaaatgcatgtataaaaaatacatagtgttgttgtagatttaagggattgtgcatttttacttttgtattaccaaacaatcctccaatcaaaaagcagacacacgcacacactatataagaggtgtgataatgatgtatagattgtaagtgtaatataagtcttcaaaatatgtcttgtggaacagatacaatctttcacaggtaaaaactgaatctttagtaggtttaaaaaagacattgtatatcgacataatcatgtgtgttataacataagcagtgatgtgaagcaggaattggatttgtatattgactccctgtcacagttaagatgctagactagttgaaggggaagaagacgaggtgtatcaactgaagtcagattatagaggaagttggagccaaatttctgagttgttggagaaggtaattacagattttgaaaccctggaagatataaatgcaattttttgtaaggacaatcatacctcctcttctcagactgatgatttccattacattttaaagggcctaagcaacaacatgtttttggtaagtctgagcatagttgcaaaccaaccagttcctaaattatgaaaattgtcattttctttcaaagcaaaatgacttaaacggctacaaatcaagttgtattgaataatccagggtttgcaatgtttactgtaattctgttttctgcaatgtgtagttttaatggttcttttattttgagaattagttctattggtatcaatatactcttagctcaagcagtaggtttgcttttttatgatactgtacaacaacttgagtggagctagcaggctgatttcatatgctagacatatctacctatccagtacttcttggcatataattttttttggacatgtacaaagtgtttttttccaagtatacaatacttcaggattaactatagtggatatgctgtacaatagatctccagaactcattcatcctaactgaaacttggtacccttcgaccaacatctatctcctcattctcctcccccacatcctggcgaccaccgttctactcttggcttctatgagttcaacttctttagattacatgtagacgtgagatcatgcagtatttgtctttctgtgtttgacttatttcattagcataatgcttatccatattatctcaaatgacaggatttcctttcttttttttactctaaatagtattccattgtgtatatataccacattttaaaaaatcagtttatctgttgatgagcatatcttggctattgtgaatagtgctgtaatgacatgggagtccaggtatctctttgacttactgatttttttcctcttggaatttatacccaatagtggaattgctggatcatatggtagttctatttttaacttgttgagaaaccttcatactgttttctataatgactgtgctagtttacattcccaccaacagtatagaaaggttctcttttctacatcctccccaacatttgttatcttttatcttttcataatatctatttgaacaggtatgaggtgatatctcattgtggggttactttgagtttccctgattattaatgatgttaagcaattttttcatataccttttggccatttatgtcttcttttgagtattgtatatgcaggtcctttgccaattttttaattggattacttgttttctggctatttggttgtctgagttccttatatattttggatggtaactccttatgaaatgtatgctttgcaaataattccataggttgtttttcacttttgatcatttcttttgctatcagaagcttttattttttaacattatttatttattttaattgagaaatattgtatttatcatgttttaaaatgtgcatccattgtgaaatagctaaatgaaggtaactaagatatgcattacctcacatacctatttttctgtgtgtgatgagaacacaaaatctgctcttaacaattttcaggaatacaatatagtcatccctcagtgtagttgggagatttggttccagaagccctgcttataccaaaatctagggatactcaggttccacagtctgccctgtggaacccacatatgggaaaagtcagccctcagtgtatctgggttttgcatcccatgaacactgtatttctggattgaaaattctgtattttcaatacagaattctgcagatgcagaacccttggatacaaacggctggctgtatttattgaaaagatctgcatagaaatggactcaaagaattcaaaccagtgttgttctagagtcagctgtacattgttactaactatagtcaccatgttttacattaatgctcttcaacttatttgtcctatcttactgaaattttgtatcctttgcccaacatctccccagacctccatgtttagcccctggtaaccactattccactctctgcttctatgagttccatattttcagattccacatataggtgtaatcgtttatatttttgtgcttggcttatgttacttactataatgtcctcctccagattcatccaggttattgcaaatgacatgattttcttatttttaaagctaaataatagtccattgcatttatgtaccacattttctttatctgttcatctgtgatgtacacttaggttgcttccatatctaggctattgtgaataattctacaataaacatgaaaatgcagatatctctttgacatactgatatcattttctttggatagatatccagtagtaagattgctgggccttatgatagttctatttgtaattttttgtgaaacatccatactattttctataatgattatactaatttacattcccactgacagtgtgaaaggatttccttttctcctgtaggttttcagtttgatgcaatccaaatggtatatctttgcttttgtcacctgtgcttttggagtaatatccaaaaaatcattgcctagatcagtgtcaaaaagcttttttccctgttttcttctagcagttttacagtttcaggttttatgtttaatccattttaagttgattttccctatgatgtgagaaaagatccaatttcattcttctgaatgtagacatctagttttcccaataccgcttactaaagacactataatttctccattgtgtattcttggcatttttgtcaaacagtagtggactgtaaatgtgtgcatttatttctgggcactctattctgttccattggtttatgtatctgtttttatgacagtagcatgctgtttcaatttctgtagctttgtaatatgttttgacattaggtagtgtggtgtcttcagctttgtttgtattgctcaagatttctttggctacttggggtcttttataattccacatgatttttagaatctttttcttctacttctgtgaaaactgtcattgaaatttttgtagggattgcattgaatctatagctcactttgggtagtatgaatattttaactgtattaattctttcaatccatgaacatgagatatctctccatttatttgcatatttttctatttcttttatcagtcttttatagttttcagggtacagattttttacctctttagttaactttgttgctaggtatttttaaaatgctgttgtaaaattgcattgttttgattgtttactatatatatatatagtcagtgtttatatagactaacaatgaactaccatttttagtatatataaacttcttcattgaagaagaattcagatagttcattgttagtctgtataaacactttgtatatatttcaacatttataaacatacacaaacactatatatactaacaacatttataaacatatataaatactctataaatactaacaatgaactagcttacttcttcagatagtatacataaacactactaacttttgtacattgattttgtagcctacaactttattgaatttattatttctcaaatatttttgataggtctttagggctttttatatgatttatatatgattatgacatctacagagaccattttacttcttcctttccagtctggataccttttattccttttatttgcctaattcctctaactaggacttttagtgctgtattgcatagaaggggcatccttgtcttgttcctgatcttagaggaaaaactttcagtttttcaccttaagtataatgttagctgtgaatttgtcacatatgacctttattatgttgagatacattccttctataactaaaatgttgagagtttattctgaaaggatgttgaattatgtcaaaaggttttccttcatctattgagatgatcatatggattttacctttcattctgttaatatagtgtatcacatatattgatttgcatatgttgaaccatccttgcatcttagggttaaatcccacttgatcatggtgtaagatcctatcaatatgcttttgaacttggtttgctcatattttgttgaagatttttttatctgtgttcacagggttattggcctataattttcttgtagtatctttgtctggttttggtattaggtagtgctagactcacaaattggctgataactttgattttgttttttattctaaaccactgctttctttctttttaagcatgtttaacaatcagagtcacagtgtagagcaggtccatcttccatccccctccaactctcctcatgcccttcccagttaatcctcctgtcacaacctcccaaagttctgggattacaggcgtgagttatcatgcccgacctaaaccactactttcaataaagagtgagaataaaacaatctatcataatgtttatgtttcttcatgcatacagtttgtataaagaatgtataatcatttttacataagcacttcacatctatatgaaatcccatttctattcctatctaagtgacgtgggtttgtttttctcaagacaaatggtttgttctattttaatttctgtcttactgtttttcttaatagggtagaaatgaacattttgagatttggaatcagactggtataatttgaatactagctagtctgtttattaattccgtatgtttgtttggatcacttctgtaaattccagtttctcatctgaaaatgaatacaattacagggcttacctcataggattgttttttcctgttaattaagtaaaatgagaaaggcagttaagaaagtgactattatatatcaagaaaataacgtatgatatctgttattattattgctattattaactattataaaaaccatgattggaagatgacaacagagctgaaactccagtgaaagactgaactagttaaaaatgcaccaaagccttgttattctgtctagacatgaagaggcttacaagtggaaccacatctttgactccgatttagaagggtggcatgtggaactcactatttcatcttttatcattccccagcactagacactataattactctggttatcactgtttctgggctcagatttcagcaggattgcatatctatcacaattaaaaaggcaaatgttgtatttttttaatgtggttagtgaagaaaagcttttaaataagtattctaaacctctggtttgagtacttgggaaaccatgaataggattgtaagaaggcattgagagaagaaaacttcaaaacttgcatttttgagataactttttaaaattctaatttccagtgaaaaatgtatagtgttcatgcaaatatatgcaaataaatacagctgcttttctattttaatcgtaaacctggccccttgaaatattttagcaaaaactatttgcatggaggctgtaataaacgatagtacatgtccctgttacatcaaacaaggcattctctgtatgtagactgctgcatttattattattattattcattacttcagaatcatatcatgtgaagactattgttctctggatcctggtgatggttttcattcagctgattttggcaatgattaaatttcttgttttgaagctagcggcatctcatatacaagttccctgagcatagagaccatgtcttatcttgctcatgactaaatctccaatgtcaagtacagtactcaaaacacaattattttttgataaacatttattaaatgaatgaataatgtctagtttaaatatatctagtgttttcatgatattctttatgtgttgaagcacccataccagttcccttcaaaatctgtgagcatagttctttcactgagtgtaggtatttgcaaatttgaccaagttttctgtaatagtacagaaaggcagaatcaatgctttctagaaaaaaaaaaatgaggttcagcttatcttgtcactattatgagaaagcatctctgtcccagtcataagatgtgtcatagactggaagtttctgggattttccataaaggagcagaatcacagacagtagaggggacatatggccccagtcgccctgctctgttcatggtgcctccttcctagtctaaggagagccagcaccactgcctctctcccatctgacctccactcatgactgcctagtacagcctgatgcacgctaaggccagagtagtgccatgaggaggtgtgtattttttatccccagtcacttatggctattttaaatctacggaagatcaaaaaaaaattatccttaagccaacctcatgtaattatacccattatacagaatagaaactgagttaatggaaagttaatgacaagttcaaagctgtcaaataataattctgtaatgggaacacatagcccttgaattttcctatatttatcctaagagcaggaacaatcctttttttgtctttcaactgaaaggttttattttattttatttttcatcaatttttattttaagtttcagggtacatgtgcaggatgtgcaggcttgttaataggtaaacatgtgccatggtgatttgctgcacagatcaacctgtcacctaagtattaagcccagcatccattagctattcttcctgataggctcccttccactgtcccccacaacaggccacagtgtaggtcattccctcccaggtgtccatgtgtcctcattgttcagctcccacttacaagagaatgtgcggtgcttggttttctgttcctgcgttagtttgctgaggataacagcttccagctccatccacatccctgcaaaggacatgatcttgttcctttttatggctgcatagaattccaggtgtatatgtaccacattttctttatccagtctatcactgataggcgtttggattgatttcatgtctttactattgtgaatagtgctgcaatgaacatacacgtgcatgtatctttaccatagaatggtttatattccttttggtatatacccagtaatgggattgctgggtcaaatggtatttctgcttctagatctttgagaaactgccacactgtcttccacaatggttgaactaatttacactcccaccaacagtgtaaaagcattcctttttctccacaaccttgccagcaactgttgttttttgactttttaataactgccatctaactggcaagagatggtatctcattgtggttttgatttgcatttctctaatgatcagtgatgttgagccttctttcatatgtttgttggctgcatgtatgtcttcttttgaggagtatctgttcatgtcctttgcgccccttttaatggggttgggtttttttttttttttgtaaatttgtttaagtaccttagagatgctagatatttagacctttgtcagatggatagattgtgaaaattttctcccatgttgtaggttgtctgttctctctgataatagtttcctttgctgtgcagaagctctttattttaattagatcccaatttgtcaatttttgcttttgttgtcattgcttttggtgtttccatcatgaaatctttgcccatgcctatatcctgaacagtattgcctacattttcttctagggtttttattgttttgggctttatatttaagtctttaatccatcttgagttgacttttgtatatggtgcccagtttcagttttctgtatgtggctagccagttctcctggcaccatttattaaataggaattatttcttcattgcttgtttttgtcaggtttatcaaacatcagatggttgtaggtgtgtagtcttatttctgggttctctattcttttccattggtctatgtgtctatttttataccagtaccatgctgtttaagttactatagcactgtagtatagtttgaagtcaggtagggtgatgcctccagctttattctttttgcttaggattgccttggctatttaggctcttttttggtcctatatgaattttaaaatagttttttttttttttacttctgtgaagagtgtcaatggtagttttacaggaatagcattgaatctacaaattgctttgggcagtatggccattttggcgatattgattcctcctatccatgagcatggaatgtttttttcatttgtttgtgtcctctctgatttctttgaacggtggtttgtggttctctttgaagaggtccttcacttcccttgttagctgtattcctaggtattttactctctttgtagcaattgtgaatgagagtttattcatgatttgtattttctgcatgcctgctgtttgtgtataagaatgctagtgatttttgcacattaattttgtatcctgagactttgctgaagttgcttatcagcttaagaagctttggggctgagggccgggcgcagtccctcatgcctgtaatcccagcactttgggaggctgagacaggtggatcacgaggtcaggagatcgagaccatcctggctaacacagtgaaaccccgtctctactaaaaatacaaaaaaaaaaaattagctgggcatggtggtgggtgcctgtagtcccagctgctcgggagactgaggcaggagaatggtgtgaacctgggaagcagagcttgcagtgagccaagattgcaccactggactccagcctgggcgacagagtaagactctgtctcaaaaaaaaaaaaaaagaagctttggggctgagacaatggggttttctagatatagggtcatgtcatctgcaaacaaagataatttgacttcctttcttcctatttgaatacccaccctttatttctttctcttgcctgattgtcctggccagaacttccaatactattgttgaataggaagggtgagagaggggatccttgtcttgtgctggttttcaaagggaatgcttccagcttttgcccattcagtatgatattggctgtaggtttgtcatatatggctcttactattttgaggtatgttctttcaatacctagtttattgagagtttttaacatgaagggatgttgaattttatcaaagatcttttctgcatctattgagataatcatgtagtttttgtctttagatctgtttatgtgatgaattacatttattgattagcatgtgttgaaccagccttgcatcttggggatgaagccagcttgatcgtggtggataagctttttgatgtgctgctggatttggtttgccagtattttattgaggatttttgcatcgatgtttatcagggatattggtgtgaagttttcttttttgttgtatctctgccaggttttgatatcaggatgagtctggcctcataaatgagttagggaggagtccctcctttcagttgtttggaatagtttcaatagaaattgtaccagttcctgtttgtacctctgttagaattccgctttaaatcctttggtcctcagctctttttttggttgatgggctatttcttacttcctcaatttcagaactcattattgatctacttagggattcaatttcttcctggttcagtcatgggagggtatatgtgtccaggaatttatccatttcttccaggttttctagtttatgtgcatagagctgtatatagtagtctctgatggttgtttgtatttctgtggggccagtggtgatataccccttatcatttctgattgtgaatattgattcttctctcttttcttctttagtctatctagcagtctatctattttattatttttttcagaaacaaaacagttcctggatttgctgattttttgaagggtttttttttttgtgtctctgtctccttcaattccaaagatcagaatcttatctccaagaaatgggtaaatatggtattgtgtctttgcctcaaactgcaaactttgacatctcacaaattttgaaaattccacatagccctagaagttttctgctttttcttgtttctttgaaacccatttcaatgtaactttttctttgatttgctctcttgtatacaaatctaaatagaaccacaaaaaaaaatatgcaataccatttggaaaaaggaagcaatttataaataatcaatgactaataaaaatgaaactagttttccttttttaacacttgataaagaaaagttaggtcaactttgaagcacttaataaagtgttttaaattaaattttttaggttggatttgtatctcaaagtagaaatgcctagtcagccttatcaatgaatactccttttggtttgcattacatatctgaacagtttttttcatttgcattaaatatcctaatatttttcctaatatgttaaaagatgatattgcatctgtctgatcagacatactggtccaaaacttaatttactaggatatgaaatctttgttagcttggagaaataatttccaattatgcatttcagtctcaaaatgcacacctaaacccatttaagactagctaagaacatttttataatgcatttcttagaattagctacagttatggactagtttttcttagtctttttttatgaatcaaagatagattgtctaccattcttcctcccctcccgttcaccttgttctagatggaatgaattgatgcaatttattctgtatcatttaactcatcctttatttctataaaggcaaaaataaagatataagtgtgaatccatgttttcctatttttttggcatttaaaccgaagtgtagaagattaggtattaattataattgcttaaaattcttcatagtagctttttaaataaatgggaattccaagaataattataaggtgattttaaaaacaaaaatacaagaacttatgctcctaaataattgttatccttctaggaagttatattggataaatagcaaccttattgaaataacctgtggcctgaagtaacagtgaaagacctatatggatttaaaacatctttctaccacttaaaaatagtatgatctaaggcaagttatttaagcactctgtctctcaatttaggtatctgtagattgttacaaaatggccttgagtggaagacatctccctaaatgcatcccgcattgaatcctggctggccttaggccgacagaatgtaacagatgtgacatcttgccagttctaagcctaggcattgaagagcttttgtagcttttgtctgaaatcaaaccactctgctatgaagatggcccatctaccctattggagaatgagaggtcatgtggagaaaacatgtggtagcttagctggcagccaaaagccagacgtgagcaagtccatcctggaacctccagcttcaattgagtcatccagtgacatcaccacatgaatgatcctaagtgacaccagcagaagaaacaaccagattgccaatgcacactaagaaccaagccaggtactaaattaggcagagataagggctggagtttagagattctaactccagtaatgtgctacttccacctctctgtctgaggggcaaccatctggcaatcctgagtacaaggcagaaattcagcatttggataaggaatctgctactgcttgggggtgtttgcaggaggaaatatagacatgcagttacaatgataccatccgtttctgaaaggtaagaagcaaaacacatgactagacacaacttccaagtcaagttaggagtttttcttttgtgctatgtgttggttaaaatcagaatctagcattatatgacttcagaagcttcctagttacacatacccagggaaggagaattcccataatcccataatcttattcagattaaactgatttattcacttccaattatgtgccattttttgagaaccttatcttggtaagagtagatttgggtgagagggaatcagtcttaggtagaattgaagaatctcagcaccagctaaatatttttgagcagcctatggacacgtttccagtgagagaaagaaagaggattggctaagtgtggtagctgacaccttccactgtgctcacaaagtgtgttgctctactccatgcagctctgaccagcagcattgacataatgacctccttgctacagggagcatctcaagctcagggattcaggctttttatcttttaaatagaattgccagacagcatacacgatgcccaatttaatatgaatctcaggtaaacagcaaatcatttttcagtatgtctatgcaatatttgtgacatacttatatcaaaaaatgatacactgttaatctgaaattcaaattactatttaactgggtgtcctcttgtgtttttagtcggtttgcttattttgcttcatttgttttgtttttggctaatctggtaaccctccttagaaatgaatgtcaatacagttgtgccatagaagaggtgctcaaggctgggcgtggtggctcatgcctatagtcccagcattttgggaggccgagatgagtggatcacttgagcccaggagttccagaccagcctagccaacatggtgaaaccccgtctctactaaaaatgcaaaaaatttagccaggcatgttgacatgtgcctataataccacctaccagggaggctgagatgggaggatcacttgagtccagcaggtggaggttgcagtgagccgaaatcgcaccactgcacactagcctgggaaacaaagcaagagcaagactctatctcaaaaataaaaaaaaaaagaggtgctcaataaatgctatttgaatattgattcaaactttttgcaattccacctaatttcttgtcttgttatcatggttccactaaccttttcgatgtcacagactctagtgtgattctacacagaaatctcaacccctgtaataattatagccaaaataacagtattatctatatttctgcagcagcttatggtttttcaaagagggagtacttgcttattttaaaaataaactctgagtaattacacagttaaactgtggctgtagatgaaaagaaaatggagagagtgaaaaatggtggttcatagaaagatctttgtgcttacataaggcactacatttctggttcatacattttccctcatattctgaaatcagatcgttgtttttctaacatgactgtggcaggttcaaaggaagagaaaataactaaatgtagaatactgttggctgtaggtgaacatgcattaattccctgtcatcccatttcatgccttgcaatcttccaactgttaattaagacaaacagcaaaatcatatcctttagcaaacagtctagtaccctttcccagtctgggatgtgacaggcaccacactcaaagtatgctttttttggtcatctttatatagcataatagaccaaccaagtacaagttaagcagactgaaaggaagaattatttcacactcctgctgatgctgctggaaagtgtagaaatgatcttggagtgcttcctttagttctttatcctttagaatagctcacagaaggcaacctaacaagcattaggattcacaatgccatctgtctgttaaaaatatagtctaattccaaagaagggcattacataatagtaaagggatcaatgcaacaggaagagctaactatcctaaatatatatgcacccaatataggagtgcccagattcataaagcaagttattagagacctacaaacagacttatactcccacacaataatagtgggagattttaacaccccactgtcaatattagatcaacgagacagaaaattaaaaaggatattcaggacttgaactcagctctggaccaagcagacctaatagacatctacagaactcttcaccccaaatcaacagaatatacattcttctcaacaccaaattgcacttattctaaaattgaccacataattggaagtaaaacactcctcagcaaatgcaaaagaatggaaatcataacaaacagtctttcagaccacagtgcaatccaattagtactcaggattaagaaactcactcaaaaccccacaactacgtggaaactgaacaacctgctcctgaatgactactgggtaaataacaaaattaaggcagatataaataagttctttgaaaccaatgagaacaaagacacaatgtaccaggatctctgggacacagctaaagcactgtttaaagggaaatttatagcactaaatgcccacaggagaaagtgagaaagatttaaaattgacaccctaacatcacaattaaaagaactagagaagcaagaggaaacaaaagctagtagaagacaagaaataactaagatcagagcagaactgaaggagatagagacacgaaaaacccttcaaaaaaatcaatgaatccaggagctggttttctgaaaagattaacaaaatagactgctagccagactaatgaagaaaagagagaagaatcaaatagacacaataaaaaatggtaaaggggttatcaccactgatcccacagactaccatcagagaatactataaacacctctacgcaaataaattagaaaatctagaagaaatatataaattcctggacacatacaccctcccgagactaaaccagggagaagtcgaatccctgaatagaccaataatgggttctgaaattgaggcaataattcatagcctaccaacaaaaaaaccccaggaccagacaaattcacagccgaattctaccagaggtacaaagaggagctggtaccattccttctaaaactattccaaacaatagaaagagggaattctccccaactcattttatgaggccagcatcatcctgataccaaagcctggcagagacacacagaaaaaaagagaattttaggcaagagaattttaggccagtatccctgatgaacctcgatacgaaaatcctcactaaagtactggcaaaccgaatccagcagcacatcaaaaagcttatctaccacgatcaagctggcttcatccctgggatgcaaggctggttcaacatatgcaaatgaatcaatgtaatccatcatataaacagaaccaaaaacaaaaaccacatcattatctcaatagatgcagaaaaggccttcaataaaatttaacaccccttcatgctaaaaactatcaataaaataggtattgatggaatgtatctcaaaataataagagctatttatgacaaacccacagccaatatcatactgaataggcaaaagctggaagcattccctttgaaaaccagcagaaaacaaggatgccctctctcacccctcctattgaacatagtattggaagttctggccaggacagtcaggcaagatcaagaaattaagggtattcaaataggaagacaggaagtcaaattgtctctgtttgcagatgacatgattgtatatttacaaaaccccattgtctcagcctaaaatctccttaagctgataagcaacttcagcaaaatctcaggatacaaaatgaatgtgcaaaaatcagaagcattcctatacacctataatggacaaacacagaaccaaatcatgagtgaattccctttcacaactgctacaaagagaataaaacacctaggaatacaacttacaagggatgtgaaggacctcttcaaggagaactacaaaccactcctcaaggaaataagagaggacacaaacaaatggaaaaacattacatgctcatggttaggaagaatcaatattgtaaaaatggccatattgcccaaagtaatttatagattcaatgctatccccatcaagttaacattgacttttttcacagagttagaaaaaactactttaaatttcatatggaaccgaaaaagaacctgtatagccatgacaatcctaagcaaaaagaacaaagctggaggcatcatactacctgacttcaaactataccacaaggctacagtaaccaaaacagcacggtactggtaccaaaacagatgtatagaccaatggaacagaacagagccctcagaaacaacaccacacatctacaaccatctgatctttgacaaacctgacaaaaacaacaatggggaaaggattccgtatttaataaatggtgttaggaaaactggctagccatatgcagaaaactgaaactagaccccttccttacaccttatacaaaaattaactcaagatggattaaagacttaaatgtaagacctaaaaccataaaaaccctagaagaaaacctagacaataccattcaggacttaggcacgggcaaagacttcatgactaaaacaccaaaagcaatggcaacaaaagccaaaattgacaaatgggatctaactaaacctaagagcttctgcacagcaaaagaaaccatcatcaaagtgaacaggcaacctacagaatgggagaaagtgtttgcaatctatccatctgacaaagggctaatatccagaatctacaaagaaacaaatttacaagaaaaaaacaaacaaccccatcaaaaagtgggcaaaggatatgaacagacacttctcaaaagaagacatttttgcggccaacaaacgtgaaaaaaagctcacgatcactggtcattagaaaaatgcaaatcaaaaccacaatgtgataccatttcatgccagttagaatggtgatcattaaaaggtcaggaaacaatagatgctggagaggatgtggagaaagaggaatgcttttacactgttggtgggagtgtaaattagttcaaccattgtggaagacagtgtgtcaattcctcaaggatctagaaccagaaatgccatttgatccagcaatcccattactgggtatatacctaaaagattataaatcattctactataaagacacatgcacgtgtatgtttattgtggcactgttcacaatagcaaagacttggaactaatccaaatgtccatcaatgatagactggataaagaaaatgtggtacatatacaccatggaatactatgcagccataaaaaaggatgagttcatgtcctttgcagggacatggataaagctggaaaccatcattctcagcaaactaatacaggaacagtaaaccaaataccgcatgttctcactagtatgtgggagttgaacaatgagaacacacagacacagggaggggaacatcacacaccagggcctgtcagggggtggggggctggggagggatagcattaagagaaatacctaatgtaaatgatgggttgatgggtgcagcaaaccaccatggcatgtatatacctgtgtaacaaaccttcacattctgcacatgtatcccagaacttaaagtataataataaaaaaagtacagtctaattcattagacactgatatatatatatatatagctttgtttgctagttatttcttattgctctctgttgacccgaaactaagtcattaagcagcaggaaaagtaataagagctaattttctgttcaagtcaagaaaatgtgctacctttatagtgctttaggaagtcttcatcatcaaaaaatactaaagaatactggaagaggaaagcatttacatattaaagtggtaaaaagatagaggccaaagtctatacaagagataaaactaatcaaataacagccataactcttaagggatatgactgtctgcaaagactaacatttccttctactatttaagagaaaataaccccaaatcaaaaccagaaaattaaatgaactgaagacaatttattgcaaaatatgacaatctgtacaaactttgtgagaatggcatctctttgtactatgctccagagtttgtctaatctttcaaggatgaaatgtttacccccagttgtggttctctgagatctatgtttcttacttgattagacacaggacaaaaatctcaaaagaatcctttgagatttttttgcatttatatttgagatttacatttatatatttatatgatatatttgtatataaatctgtgcattatgtattatataaatttggcaatttagataatgtattctccttagtgatatctaaggagctatcatattcccttcttagttatcttcccaggagtgaagtgaggtgatatgaattgagcaattgaggcagattttaacagcaattcctctggatcaggactaaatatttttgttggtggtgcttgtttttattctgcatatattatatatatatatatatatatatatcattaaatttaccttttaaaatgactttaagtgtataattcagtggcattaattatattcataatgttgtacaactatcactactatctatttccaaaaccttttcatcatgccaaatacaaactcagtaactattaagcaataactctccattctcccctctgccaatactggtaacttctaatctactttttatcactatgaatttgcctatactagttatttcatataaataataaagtatttgtccttttgtgtctcactcattgcactcagcataatgatttcagggttcatccatgttgtagcacatgtcagaactttattcttttttatggctgaataataatccgtagtaagcatatacattgtgtttatagagtcatcttttgatggccactaggttgtttacaccttttcgctattatgaataatgctgtgatgaattttggaatataagtatatgtttgaatacctgtttcaaaaaacaaaaaaaaagattgtttcctgttttgaaaaactgctgcaccacattacactcctaccatcaatgtatgagaatttcggtttctccccatccttgccaacgcttgttttccttttcattttgtttatttatttcagtagatttagggggtacaagtgggttttggttaaatggatgaattgtgtagtggcgaagtctgggctttgttttttgttgttgttgtttttcagacagattctccctctgtcgccaggctggagtgcaatggcgcaatctcggctcactgcaacctccgcctcctgggtttaagcgattcttctgtctcagcctcccgagtagctgggagtacaggcgtgcccatgcccacctaatttttgtgtttttagtagagacggggtttcaccacgttggccaggttggtctccatctcttgacctcgtgatccgcccacctcaacctcccaaagtgctgggattacaggcgtgagccaccgcacccggccaaagtctgggcttttagtgtgcctatcacctgaaaaatgtacattgtacccaataggtaatgtttcatccctgacccctgcccctctctgagcctccagcgtcctttataccactctgtgtgcctgcatccccttagcttactccctcttataagtagaactaagtatttttgactaaagatttggagcgccatgctgcctccatcctcatcagaaagcaccatgttgccattcgatggaaacctttgacaatggagcaccatgctgacagacgagaaccaaaaggaggctccagggctgctgccccacgtgccatatattctgactgtatggcaggttcttgaattcactgcttcaggtcctttgaattgtaacaaatgccttcaggttacaagcccttagtttattatgacttgtgtgcttcctttttacagccctaacaaacataagactcttaatgtaaaggagatctgtagagaagcttcacttacactctaatttggagatttgtcaacatcagtgtattaatccctttcctccctccctctctcttccttctatgtgagtttatcatttgaatgtaaacatttgcctttgaactgactggataattggttcggagactctttaagcatttatttagaaagcaaagttcaggtttaatttccctacagttacatagtatagtgaggtgggaatcttcactgcatattccagctgttttgatataattagatgtttatgctatgtccacatccgcttttcccttctcacactcctctagttttccctgtaccattggtttataaatcactcccaaactgcccctccttaatcaggccaggcagaagccagcggccccatgccagcggccagcagctggagatgtggggtcgcagccacgcggcgtgacccagggtcagaaagagtgggccagagagaaccatggcccgcactgctaacttccaggacatccacaattttcattcccaggaagagtctttcctgggaaaggtacagaaatttcagttgctctagcatgtagtgggattttataatgagccaggcaggaaaataacagatggtgcactgagtgtaaatatatgaaaatacccttggagcagaaacagaaggctggcactcccaggggactcgggcgaaaacagacaagactccccgctgtctctcagctcttctaatgtttttctcacgtcttaaggcacagacaatgtctattgcatgtaacatcttatattctctcaccttagtgcaccaaatcgtgatcctcttggaggccctcccctctgatctctgtgccctctaatctccttgcttcctcctctctgctcaggtttgctttcttgggtctctcctctttcatcttagctgtttctccaggctgtttgaaggttcccacctccgttctttcttggttctggatctgtctgttagaatgactccaactccagcgctgtggctttcaccatgtttcttcactttcatgtctttttttatttataattgagcacacacacacaccacacacacactctctctctctcctatacttccttctttagaaagctttctgctgttgttgttgttttaataatctttcagatcattttatttagctttcatccatttccctcattaaagtcagttgaaagttttgtcaacatgtaatatgcatttgatataatgattttagtataataattacctgaggtaacactgtgtcagaggagaagtgtggccaattatatcttaaattacatgaacagcgctttccctttcacacagctatacatttctttaggcactaaaaatctgtaatctgtagcttccattaaattggatttagttgttttgcaaataaaattgtggaataaaaggttgtattagttactgttctccagagaatgagaatgaatagggtgtatgcatgtgtgtgtgtgtgtgtttacaatcagttgactctaagtaaagcagtggagagcaatgggtgggcctcattcaatcagtggcaggcctaagagcaaagagagatttctcaaaaaagaaggaagtttcctcaagactgcaacatggcaaagctgctcagtagactcagttagtctattgccctgcagaatttggactgaaagctgtgacatcaattctttcttaaaactctgagagattgcttgattgattttaaggaattggcttacatgattgtgggggctgacaagtccaaaatctctagggcaggccagcaggctggagactcaggacagagttaaagttgcagtcttgcatataaattctgcagggcagtagtttggaaactcaactgggtttctgtgtggaagtcttgaggagaattctttcttctttgagaaacaggctttgtttgcaatctttgctcttaaggctttcaactaattgaaagaggcacacctgtatgatggagggtaatctgctttacttaaagtctactgattataagaattaatcacacctaaaatatacctttacttcgtggcaacaacacacactgggaacgactagacaggggcaagggttgaaaaactaactgttgggtactatgctcactctccgggtgacaggataattcatggcccaaacctcaacatcaagcaatgtacccacgtaacaaacctgctcatgtacccctgaatctaaaataaaagttgaaattattaaaaagaaatattgaaggaatgatataaagattttaaatgaataaataataataccttgactggtgtttggccaaacagctgggcattctagtcctcgccaagtcaacacacaaaattaaccattacagtggtgtttccccatttgtagggagagggaaaggatcacatttaatgaaaaacatttttgtttccgaatgtatatttctaactcatttttctttgaattttcttatattttcatgtttatacagaaatacggtatattggcatttaatttagcacaaaacttgagattcgttattctaaagttttaatattttgtgatgctctacaagaaggactgtaactcccagacacaaagctacctgcaagttcaagcattgctgctttttacatgaaatgtcatggtaactggcaaggattccccaagggcctagaagtagtggaagtcagattccccttatatgcagtgtactgtatgaacatatttacatcctccaacaataggctgcctttagcagcctgtaggtttggaaaacactatttttgtttgggctccgggtccagccatttcaagcctggtaataactgcggtctccctcaccaccttcctcaccaactggaatggtgtgttggaatattttcagctgttaattacataatacctcaaaacagtgcttaaatagatatttttgtccacataaaaataatctgaaggtaggtggttccaggttagtaaagtggtcagtgatgtcaggagccgagtccacatctctctgggtctgtggcctcccttcacagtcgcatgagagctgctgtagctctaggtgtctccttacaacaccatggtgcttgaaagcaggaaacgggtgggagggaacaaaaccttcttctcatacatttcccacatttcaggtagaaaaagtttcccggaggcggaggttgcagtgagctgagatcgtgccactgcacgccagcctggcaacggagcgagactctcttaaaaaaacaaacaaaacaacaacaaaaacgaaaaatgtttcccagaatcctcggcacaggtttctgcttccacctcataggccaaattgatcacatgttcttccctagccaatgaccgggcctttctcccctgacataaggggatctctcctgtcaaatgaatacaataaggttgggttagcaagcaagaaagtgggtgtggatgccgttgaatagctgcagcaatatctaccagatgccacccctttggccgcttggcattcacactcaccctccttccacacatacacaacacatcagccctcactgcacaaatgaggcccacagcttccttcagctccaacgccatgatctcaggtgaccacctggactctctgtcaagtccaaatgttgctcctcacaaatgtctcctatagtaaagcataagccatctgtccactacatacctaagacatagaaatggagaaggaacaagttaaccctaataaagccttgtatttggcagaggggagaacaggaaatagtaaccacttgtttacagcacatatcagatactgctcagcaggaatagtgaggaccatatattctggaaatggagtaagctcctcttagctgctctgagagccctgattctttctttcagtagattttcttgtccattttaccacatggcaattttggaatgcacattggagagtaaggtcttcctaggggctgtagagattgcgcagccctcttcctattggtggaattgtggggaactgggaattgctttgaggattgaactttcacagaattctgcagccagccttggaagttctgttagcacaactccgttatcttaaaaatttagtatgcttgttgtcacagaaattaaaaaaaaaaagacatcataacttctgaccacaataaaattaaaagtaaaaataaggttttttaaggcataagaaaagtcttatgattaaaaatacactcataagtaatactaattcctgctcaagaaagaaattatgatatacatttaaaacaatagaaaaaaatggaaatataccatatatcaaaacctgtacacggcagataaggtggtatttagaggttaatttgtagccttaaataaatatctcaaaaacattatatgtagccttaaataaatgtatttaaatagtttttaaaatgaagaaaaccattcagctaaaggcactagaaaaagaacaacagcataaacttaagttttgtggtttttttttttttttggagacagggtctcactctgattgcccaggttggagtgcagtggcgtaagtttggttccctgcagcctcaacctccccaggcttctcccacctcaacctcctgagtagctaggactacaggcgcacaccaccatgcccagttaaatttttttagttttgtagagatgcagttttgctgtgttgcccaggctggtcttgagctcttggactcaagcaatccacccaccttagccttccaaagtgctgggattattacgagtgtgagccactatgcctggccaacataaactttaaaaagtagaaaataaacttaattctaaaattttaagagcagaaattactaaaaagaagaaaaaatagagattaacaaaatcaaaactgattattgaaggaaaattaataaaataggcaacattctaagaagactgagaaaaacaaaataagaaaaaatacaacattagaaattttaagagcagagatactttaagatttcaaaacgtataacgggatacgttaaaaactttatgacaatattttaaaattagattaaatggatactttaataaaaatggcaaaaatttgacaagaagaaacaaagaatctggataacataataataaagacattttatctcatcaagatgtaaataatttctattttatataaactttttcaaagaagatgaaaaaattacctatctcattgagtgaggataaatcttgctttgtaaggatagaataacactgacaaggacagtaaacgaaaagaccatatgacctactagaatataaatgaaaaaaatcgggggaatagcattaggagatatacctaatgttaaatgatgagttaatgggtgcagcacaccaacatggcacatgtatacatatgtaactaacctgcacattgtgcacatgtaccctaaaacttaaagtataataaaaagaaaaaaatcctaattaaaatattttcaaattgaattcaatagtatattaaaaatgataatacttaagtagcattttatccctataaatgaaaatctggttcaagagaagaatcctctaatgtcgtttaccacataagaaattacactggtggttgccgggtgtaaggggaggggaaatgggcagttcttcttttaaggacatagagtttcaattttggaagatgaaacagttctgaagattggttgtacaacaaggtgaacatacttaacactactgaactatatatttagaaacagttaaaatagtaagctttgttttttctaataaagctttttaagacattgcagaacaaatatataaattttatctcaatagatacagaagtgttcaataaaatcagtggtcatttataatttttttaaaattagcacatctgaactataaaggagtttccccactgtggttggctcgataacgatccccttatgtccacatcctaatccctggaacctgtgaatgtcaacttgtagggcaaaagggaccttgcaaatgtgattaagaatctcaagaaaggaagagtatcctggattagctatggggcccagtgtgattacaaggatccttagaagagggtggcatgaggagtcaaagatcagaaagagacgtgatggtggcagcgtttggagtgacgtgctttgaggatggaattccttggctgccaagggattcaggcaggcactagaagctgaaaaaggcaaccaaacagatactttcctcagagcttccagaaaaaaccagcccaacagacaccttgactttaccttagtaaagctgattttgcaatctggcctccatgactataagaaaataactgtgtgctgtttttaagtcactgttttttgtaagttgttacagcagcaaagggaaactaatacactcaatatcattgattcatttattcaacaaatatttagtacagacctgtcatgtattaagcgcttttccagactctggagatatcaaaataaacaacaaaaaaagcttcaaacaaaacagtaacaacaaattctaccctgttgcacttgtattctaatgaggaagttgagggtaaataatcacaaattagtaaaaaaaaataaagttagacaatgatcatctccaaggagaaaaataatgcagggaggagaggacgtacacatcatggtagaggaggtattgttactgaaacaccaggtgctcggtctaggctctgctgctcaccgcacagaaagccaatcactgagatgatgagtgttgccaaggaagaaggctttaattgggtgctgcagctgagaagatgggagctcagtctcaaaatccatctccctgactgaccaaaactaagggtttatatatcaggaaagaaatgtaacaacgtgtaagaagacaggaactccggaggagcaaaaaaacaatcataatgaatgagaggtggcatcccattatctggatgtgatgatctggtgagttccagttccttgatccttttcttgagaggcatgaaggttgtttccggaggaactcagataaaataaatataagtttcaagctttaagaccagagggtcaacttctatgtttatcaaaaaataaaataaactatctgtgggactattgggtcactttcagtgagatgcatttctggattgggagggtaggataggagtcaattaaaaagtgtcattggagtaacatcggaggaagtaaggagcagggccttgtatgtgtctgggataagagcactacagtcagaaaaaagtagcgagtgtgaagtttagaggcaggggcgtgggcctgtcaggtgagagaagaccagtgctggagtcaagggagccagaggagagtcccaggagatgaggtcagagaagcaaggatggctgtagaccatgccaggccccacagattgcaatgagggctgagggcacactggggaccctttgtaaggtctttttttaaaaaattattattattatactttaagttttagggtacatgtgcacaatgtgccagttagttacatatgtatacatgtgccatgctggtgtgctgcacccattaactcgtcatttaccattaggtatatctcctaatgctatccctcacccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctcaaaggacatgaacttatcattttttatggctgcatagtattccatggtgtatatgtgccacatttcttaatccagtctatcattgttggacatttgggttggttccaagtctttgctattgtgaatagtgctgcaatgaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatttgcatgtctctgatagccagtgatgatgagcattttttcatgtgtcttttggctgcataaatgtcttcttttgagaagtgtctgttcatgtcctttgcccactttttgatggggttgtttgtttttttcttgtaaatttgtttaagttcattgtagattctggatattagcctttgtcagatgactaggttgtgaaaattttctcccattttgtaggttgcccattcactctgatggtagtttcttttgctgtgcagaagctctttactttaattagatcccatttgtcaattttggcttttgttgccatttcttttggtgttttagacatgaagtccttgcccatgcctatgtcctgaatggtaatgcctatgttttcttctagggtttttatagttttaggtctaacgtttaagtctttaatccatcttgaattaatttttgtataaggtgtaaggaagggatccagtttcagctttctacatatggctagccagttttcccagcaccatttattaaatagggaattctttccccattgcttgtttttctcaggtttgtcaaagatcagatagttgtagatatgcggtgttatttctgatggctctgttctgttccattgatctatatctctgttttggtaccactaccatgctgttttggttactgtagacttgtagtatagtttgaagtcaggtagtgtgatgcctccagctttggattgacttggtgatgcgggctcttttttggttccatatgaactttaaagtagttttttccaattctgtgaagaaagtcgttggtggcttgatggggatggcattgaatctataaattaccttgggcagtatggccattttcacgatattgattcttcctacccatgagcatggaatgttcttccatttgtttgtatcctcttctattttattgagcagtggtttgtatttctccttgaagaggtccttcacgtcccttgtaagttggattcctaagtattttattctctttgaagcaattgtgaatgggagttcactcatgatttggctctctgtttgtctgttattggcgtataagaatgcttgtgatttttgtacattgattttgtatcctgagactttgctgaagttgcttatcagcttaaggagattttgggctcagacagtggggttttctagatatacaatcatgttgtctgcaaacagggacaatttgacttcctcttttcctaattgaataccctttatttccttctcctgcctaattgccctggccagaacttccaacactatgttgaataggagtggtgagagaggacatccctgtgttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttgttggttgtgtctctgcccggctttggtaccaggatgatgctggcctcataaaatgagttagagaggattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatcaatttctagattttctagtttatctccgtagaggtgtttgtagtaatctctgatggtagtttgtatttctgtgggatcggtggtgatatcccctttatcattttttattgcatctatttgattcttctctcttttctctttattagtcttgctagcgatctatcagttttgttgatcctttaaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggctgttcagtttccatatagttgagcggttttgagtgagtttcttaatcccgagttctagttcgattgcactgtggtctgacagacagtttgttataatttccattcttttacatttgctgaggagagctttactttcaactatgtggtcaattttggaataggtgtggtgtggtgctgaaaaaaatgtatattctgttgatttggggtggagagttctgtagatgtttattaggtccacttggtgcagagctgagttcaattcctaggtatccttcttaactttctgtctcgttgatctgcctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctctgttggtttaaagtctgttttatcagagactaggattgcaacccctgcctttttttgttttccatttgcttggtagatcgtcctccatccttttattttgagcctatatgtgtctctgcacaagagatgggtttcctgaatacagcacactgatgggtcttgactccttatccaattcgccagtctgtgtcttttaattgggacatttagtccatttacatttaaagttaatattgttatgtgtgaatttgatcctgtcgttatgatgttagctggttattttgctcgttagttgatgcagtttcttcctagtctcgatggtctttacattttggcatgattttgtggcggctggtaccggttgttcctttccatgtttagtgcttccttcaggagctcttttagggcatgctcggtggtgacagaatctctcagcatttgcttgtctgtaaaggattttatttctccttcacttatgaagcttagtttggctggatatgaaattctgggttgaaaattcttttctttaagaatgttgaatattggcccccactctctttgggcttgtagagtttctgccaagagatccgctgttagtctgatgggcttccctttgtgggtaacgtgacctttctctctggctgcccttaacattttttcctcatttcaactttggtgaatctgacaattatgtgttttggaattgctcttctcgaagagtatctttgtggcgttttctgtatttcctgaatctgaatgttggcctgccttgctagattggggaagttctcctggataatatcctgcagagtgttttgcaacttggtttcattttccccatcactttcaggtacaccaatcagacgtagatttggtcttttcacatagtcccatatttcttggaggctttgttcgtttctttttattcttttttctctaaacttcccttctctcttcatttcattcatttcatcttccatcactgttaccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttggtttgaatttcctcctgtagctcagagtagttcgatcgtctgaagccttcttctctcaacttgtcaaagtcattctccatccagctttgttccgttgctggtgaggaactgcgttcctttggagtaggagaggtgttctgctttttagagttcccagtttttctgctctgttttttccccatctttgtggttttatctacttttggttcttgatgatggtgatgtacagatgggtttttggtgtggatgtcctttctgcttgttagttttccttctaacagacaggaccctcagctgcaggtctgttggagtttgctagaggttcactccagaccctgtttgcctaggtatcagcagcggtgtctgcagaacagcggattttcatgaaccgcaaatgctgctgtctgatcgttcctctggaagttttgtctcagaggagtacccggccatgtgaggtgtcagtctgcccctactggggggtgccttccagttaggctgctcgggggtcaggggtcagggacccactttaggaggcagtctgcccgttctcagatctccagctgcatgctgggagaaccactgctctcttcaaagctgtcagacggggacatttaagtctgcagaggttactgctgtctttttgtttgtctgtggcctgcccgcagaggtggagcctacagaggcaggcaggcctctttgagctgtggtgggctccacccagttcgagcttcctggctgctttgtttacctaagcaagcctgggcaatggcaggcgtccctcccccagcctcactgccgccttgcagtttgatctcagactgctgtgccagcaatcagcgagactccataggcataggaccctccgagccagttgcgggatgtaatctcctggtgcgtcatttcctgagcccgttggaaaagtgcaatattcgggtgggagtgacccgattttccaggtgccgtctgtcactcctttccttgaccaggaaagggaactccctgatcccttgcgcttcccgagtgaggcaatgcctcgccctgcttcggctggtgcacggtgtgctgcacccactgtcctgcgcccagtgtctggcactccctagtgagatgaacctggtacctcaggtggaaatgcagaaatcacccgtcttctgtgtcactcacgctgggagctgtagaccagagctgttcctattcggccatcttggctcctcccccccttgtaaggtcttgaacagaggagggataaaagataaaattcaactcctgtgttacaaacattgttctagtgctgtttaggaaatcgtctgaaagaggagaagagtgataccaggaaggccaattaggaggttaatgaaaaaacattagcccaaaatgatggtgccttagaccagggtggcagtcgtgaagacggcaaaaagtaattttgtaaatatttatataaagtagaactgccatgatttactgacaagctaatgtggcgtgtaaaagggttttggcctgggtaactgacagaatggatttgcctttagtcaagatgaagtagagtgagtttggttggggaaggatggaaaataccaggcattcagtttgaaatgcacaatttgtcattcaagtagaagtgaaaagtaggcagttggacatacaaatttaaacttctgaaaaacttaacaaactagagatataaatttaacataatcaaaaataggtagtattcaaagccaagagtgagcatacatagaagaaagaaacccgggaactcattcctggaactccaacacatcaaagtaaaggagatgaggaagaactagcaaagagagtaagaacagctggagacgcagaaagaaaagcaagagaatacagtgctctaaagtccaagaaagctcttcatgaagagtatgtgggccccatatacctgattagccacgtaaaatggggactcagcatgacccagcggtttcagtcacacggagggcagaggcaaaaatgggcagccggtataggcgcacgacggacagcacacttcatgatgacactttggaagcagcttcactgaattttcagggaaagacaaacatgccctctttcatctcttctagtcacaagtgtaccagagcttaacgacaacaacaacaaaacaggaaaaacaaatgaagtacaagaagtggatggaaagaggtaaaaactcttctctgctgtttatatgatgtctgtatacaaaatccaagataatctacagataaacacttagaaactgataagagattttaaaatgtattagattcaagattagcatgcttgaatcaaactattctaccatactaaataaaaacatactttttccattaacttcctataagcagttacgtgctggttacttgaagacaggaaaggaaagagagacacctgatatgcggtgattgctgatttccaaggtgcaacttctcctcccacagcccatttgaagctaccagtgtaatgtcactgaagcagaactgccaatagttgcacgtaactggcccttgcaaactggtgtcagcgccagcacaccactgcaaatcaactaaaatgttgaataaagaaaacatcacattcatagatgttatcaaaactacaagatctattttaaaaaactaaccaaatggcaataacatgcagagatcttttttaaaaaatgttttaaattaagaacggaatacttcagaaaaagtaatactaatggcagggaagaattgatattgttgatgccaattcaccccaaataattataatttcagcacagttataatcaaatctcaacagagaatcttcaaattcatttgaaagaggaagtggtcaaaaataattgagacagtttttaagaacaacaaggtagggtgacttgcactactaaaaaataaatccctaaatacttgatattgatgttaggatgaacaaataaaacaatgtaaccgaatagagagcccataaacagttatttttagaaacctgatatataccagatgtggtattactaattagtgtggaaagagtggcctctcaatcgatggttctgaggctattgaatttccatatgggaaaataaacaaaattcaaatttctctaagacaagaaaaaaataatccaccaagaacaaactgaacaaattgcaaaatataacaaagggtaattatctcaagtttatagggagctcttaaaatgaataaatatattaaaccaaatagaggggataaatccacgaaaaacaatagttaaagttagaaaaataaagagcctattttctttttttttttttaattccttcttaaaaaaaaacgggatacatgtatagaacgtgcaggtttgttacataggttgcgtgtgccatggtggtttgctgcacctgctgacccatcctctaagctctctcccctcacccccaccctccagcaggccctggtgtgtgtggttcccctctctgtgtccatgggttcttgttgttcaactcccacttaggagtgagaacatgcggtgttcggttttctgttcctgtgttagtttgctgaggatgatgaagagcctattttcatttaaaaaatcaaaatgtattttaaagtactcaaatccattaagaatgtttaaaactaattttaaattaacaaaatacttttatttccctatcaaaatgaaaaaaaagtaaaagactgatttttaaaaaatccataatctgtgttcaagaacttatttctccatacagtaagggcaactttacagccaaacatattttccaaacttggcagaagtataaattggcaaaacctttttggattgagatatacttacggaaatttaagtataccttctttgaccaaaaaattcaaaaagttatcctaaagaaagcagaaaaagtataaagggtcatatgtagcccatttaagtgaagaaatggaaaattctttgataaccaaaaaaactagttcatagaagttccatatagtatgatgtatttttcataaaacaaaaaaagtatgtatttgaatgacttaaaattttctagaagtaacatgcagaagtgagtatttctccatgctgaagttacggagttctgttttcttgtttatattttgctgtgctttcttaattttgcagtattactcatatattaggataaatcattttcaaaaaaataagcaaagcagacatgcacttggggtttttacaaaatattttattgacaagtattatttttaaagtattatttttaatgtattatctcccaccctaggagaaaattttgtgccctctcctaggatgggcttaactataagaatgttgcaaataaggaaaaagtgagtagtatgtaccaccactctctctattttgccaactagctcagctccccctggagtccttcatgcgcatgttcccattggatgaacctcccacgtgatgtttcttggtctctaaaccaatgagtctccgtgagtcaatatccctacatcacacacacacacacacacacacacacacacactctctctctctctctctctctctctctctcgtatgatgactcctgaatcatactgtgtattaaagttgcttattcacatgtcatcttcctggtagactataaagccccagagaataagacaaatgcactattctttttatatctcccagaaacaattaacaaaataccctgcatatactgatgtaaattacttatttgttgactaaatattgcaaggacttcataggtttaacttggactaattcatggttacggttttttgttttgttttgtttttgttttttagatggagttttgctctgtcgcccaggctggagtgcaatggtgccatcatggctcactgcaacctctgcctcccaggttcgagcaattctcctgcctcagcctcccgagtagctgggattaaagtcatgcgccaccacgctcagctaacgttgtatttttagtagagacggggtttctccatgttagtcaggctggtctcaaactcccggactcaggtgatccacccacctcggcccccccaaagtgctgggattacaggcgtgagccaccacacccggccagttactttttataaattgaaaataagtaatttttaaagaaataaaagtcctttttatttaaaaaataaataattacacaaattatgaatgacattgggttcaactacaattatatttgagaagattacatttaattgatggataaatgatctgtagtgatttatgattggaaacataagggacaccttttttcctatttttatctgtgccatagaagccaaaaatgttctttcataaaacatactttgaggcctctgttagagacagacagtaagaatgcatgaaacagggtctactctaatacatcaatttcttagttatcatgaagtattttatttgctggatacaaagagattgatgtataaactaaattgataataacagctaccatttactaaaaacctgccacgctgagtgtcttgtgttcattctctccaaccccataaaaaaccttgttgtatagtgagggaaggagcagatattctaactaagctctattaactgcaaaaccaaaactctcaaccaatagatccacttttttacagatatactaaaagcagtttagtagcaatttcagcaatgtagtcaaagtttctggtgctatgtcttcaaattttcatggatcataacacatctgcagtacagttgtgatcaaattattatatccactgcatttaccaaaaataaaatgatacacaaaaagtcctcaggaaaactattctcttgaaatatctttatagtgatgcctgggggaaaatctcgtttagctaaagtgctgtttgtaattagcatggcattcccttttacgtctaaaaatagaattacaatcatcattttaacactatatatacattggtctagcttttatattttatttggatgaaaatagaatagcaaaaaagtccatgttttctcaaaaatacttacgatgaaagctggatgtattaacacatatctagcttataaaactagctacccaatagagtataatgaaatattgttcctttatttagcaattgctttttatctaggggcacagatcactgacgaaactataagaaaacaatgcaatgcaactgctatttcagtcttgcatgtgcccgggtgtaattaacaaatgtatcatatgtaaacaattacatacttcatagtacaattccaaactcaaatctcacattttagagacctacctttagaaaagctctttcttttctttagatttgatcatactgcttcagaaacactgtaagtttcacagggaaaggattattttgcaaagttgcagatccaatacattgctttggttttacatacaaagtaagtatgggaaaatttatcatgcaaataaagaggttcaacaaaatatcatacaggtatcttctattcatttttgtccagcactttgtaatttgagtgacacgtcctggccaggcaatgcactatgtggcaagagtgtagattcaggaactagatcatctggatatcacgcagcttcatgacaagcacattggtctccaggactgcattgtgggtgaccctaataaacttactcagatatttgaatagcttctctattgtttgatagagaaaaaagaatggctggacataacaccaatttttgattaccaaagctacaattctttgttttgggttttcttgagacagggtctcactctgtcgccagctagaatgcagtggcacaatcccagctcagtgcagcctcaacctccagggctcaagtgatcctcccacctcagcctcctgagtaactgggactacagatgtacaccaccacgcccaggtaatttttaaatttttttgtagagataagagtctcactatgttgctcaggctggtctcacacacctgggttcaagcagtctccctccttggcccctcaaagtgctgggactacagatgtgaaccgtcgtgcctggcccaaagaattacaaatcttaacctttatccgaagtctaatgaatttgatataatgctttattgaggataaaagaattaatttcagctaattatcttcaaaaaggatttttatttaaaaattctgtccttgcatacattttctggacataagctaggacatcatttcggtctgattttggttacaaagtgcacaggcgccgcttcaatctgctaatcaagctttaatgtgtcgtgttatgttgctctcaaattgtgaacatacggtagtttataaataaacgtctcaaggacttagtttctgaagattacggagctggaagagctactcagagaaactgaaataccttctaaaatgtattttcaagtttcttcttaaatcttcaaattggattattagagagaaagcatgaatagatctgcttcttccctttggggattgagagaggtttcgtgtctttaagaagcctcttgaaatatacagatttatttaatatatgtcagaatctagagagaattatgatatcaaatgctttttcggaaatgcagtgtatataatagagaatatgatattgttttctgaacttctttcctacatcctacgatattcaaagagtaattcagcatggcctccagccctgcagctcatccctgtgcgttttggattcaaggactccagcctgcagtggccaacaggaaatacagtaattgtgatcttgctctttgaagatgggatgataattatcacagaactcataggaaatgtcttttttgctctatagactgtgagattatgcatatcttttagtagtttattccctgaatccttaaaaattaatttaagtttaccatcagattttagattttcctctattcctacctttggttatgacatcagttttgtgaacaaagtaaactcaatacattataaaatgctgaagtaacatatcattttccctaaggcttacctcttttatttgatttaaggaaaatttcttattttctgtgggggcttagtgcattgatgtggagaaattcatccttcttggtttttgtattcttttttttttttttttttgagacggagtttcactcttgttgcccaggctggagtgcagtggcgtggtctcggctcactgcaacctgcgcctcctggattcaagcgattctcttgccccaggtttttgtattcttaaaggccaaaacatatgtctggatggcctcatgctcatctgtgcacaccatggcagaacccagtacattgttttgtttacatccccccaaaatagtgaaaaaaatgaagcaccaccatttttatcttgagcacctcttcactgttcttaacgcatttgggcggtagcagaaaagatcattccccaaaaccttgctaagcacgttgtccaggtggggagagtattactgctcagttttccagttacaggtgctctagtatctttcttctaatttaggcatcactggcaacaatcaacttgtcagatttatatagtagatgaaaatggaaaagagaaaaatcgagtccaaggctgcttttattctgaagtttaaatggcagctattatcatttcatgtagcccattatgtaggaatgatgtctaggactgtacagtttcatcatgagtttccatgagcttcttttcatttttacatcttttattttaatcagtgggaaatcacgatattagagattccactggtgccctgaaagacatgctttgtgaaatttttgtttcaaaacattatttcaaaataaataatgtatacttaattcagcaccaggacccatgattagatgcaaatgagatgacatgaaatatctttactgtgctatttacattcatatatgtttacttgtactttaaatcctataacaaaattatgtaagtaaacccaaagtataatgtttagagaaaattagttcttcacacttcaatatttatgaagtacaactttttgtaaacatggaaaattgaaaaatgtcattgaaattaacctgtagaataatatggattaaataaatgctattgctgttcctctgactttaaaaaatcaaaagcactttctagattaatctgagtaatcacaggccgcttaaagtagccaggaatataaagtggaacaaccaacctcagttccctgcatccgaaggtttagacctattttagttcatctcacgctgctacaacgaaattccacagactaggtaatttataatgagcagaaatttatttggctcaaagttttggagtctgggaagtccacaattgagaaaatgcatctgcatctggtgagggacttctgttgtgtcataacatggcagaaagcatcacgtggggagagagaggaggaggccaaactcatccttttacaaggaactaactcctgaaacagtggcatcaatccattcatgagagggaagccctcatgacctaaccatctgtgatggtcccacttttccacactgctggattgaggattatgtttctaacccgtgaaccttgggtgacgcatttaaaccctagcaacaccctagctgattcacagatatttatgctaaagcctagttgatacagtttgatatttgttccctcaaaatcccacgttgaaatgtgatccccaatgttggaagtgcagtctagtgggaggtatttggttcatgggagtggattcctcagaatggcttgatgccctccctatagtaatgagtttacacaagagctggttgctcaaaacatcctgacatctctcttgcttcctccctcaccgtgtgacacatctgctcctccttcgccttccaccataagcggaagcttccggaagcctcaccagaagctgagcagatgctggagccatgcttgtacagcctgcagaactgtgagccaaataaacttcttttctttaaaaattacccagcctcaggtattactgtgtaggaatgcaaatggactaacacactagttattttcagatatttgtaagtattatcatccttcatccaaatacaatttttaacatattttaaatgaaaataatttaagaaatatggagctggatagtaaaagagaaaaaaatgttatcttaatataattttagtgggtttatacatcaaacattaagtgggagaggtctttaagcacttgcacaaggctgaaaaacaaggaaaaggaagttacctcgtagatgtctaacagagatgcagaactgatctgcagcagcagttaggacaaaggcaatcatatatggaaaagcagataatatgatttttaaagctttgagacatttccaatttggagtaacagaatgttagccagcacgtgccaatacagccttgccagttacttattgctgacattcattctgattagcccattattagcctgagctgagctgattagtgtagtttacatctccctgggttaactacagcccatcctcattatttgcagattccagatttatgaatttgcctgctcactaaaatggatttgtaaccctcaaatcaatactcccaagtgctttcctggtcatttatggacatgcacagagaggggaaattatttatttatttatttatttcaataggttttgggggaacaggtggtgtttggttacacgcataagttctttagtgatgatttctgagattttggtgtacccatcacgcgagcagtgtacactgtacccaacgtgtaatattttatccctcactcctctcccaccctttccccaagtccccaaagtccattgtatcattcttatgtttttgcatcctcatagtttagctgccacttatgaatgagaacatacaatgtttggttttccattcctgagttattcacttagaataatggtctccaattccatccaggtttattttgttcgtttttatggctgaatagtattccatggtatatatttataccacaatttcttttttattattattattattatactttaagttttagggtacatgtgcacaatatgctggttagttacataggtatacatgtgccatgctggtgtgctgcacccattagctcgtcatttagcattaggtatatctcctaatgctatccctcccccttcccccaaccccacaacagtccccagagtgtgatgttccccttcctgtgtccatgtgttctcattgttcaattcccatctatgagtgagaacatgcgttgtttggttttttgtccttgagatagtttactgagaatgatgatttcccatttcacccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgtataccacaatttctttatccacttgttaattgatgggcatttgggctggttccatatttttgtgattgtgaattgtgcttctataaacatgcatgtgcaagtatcttttttcctgtgatgacttactttcctctaggtagatagccagtagtgggattgctggatcaaatggtatttctacttttagaactcagttctttaaggaatctccacactgttttccatagtggttctgctagtttacattcccaccagcagtgtaagtgttccattttcaccacatccataccaacatctatttttttttaattttttgattgtggccattcttgcaggagtgattttgatttgtattgtggttttgatttgtatttccctgataattagtgatgttgaacattttttcatatgtttgttggccatttgtgtatcttcttttgagaattgtctattcatgtccttagcccactttttgatgggattattgcatcgttaggcaacttcattattgtgcaaacatcatagagcgtactacgcaaacctagatggtatagcataatacacacctgggctatctagtaaaatctattgcttctaggccacaaacctgtacagcatgtgactgtactgaacactataggcaattgtaacatagtggtatttgtgtatctaagcatatgtaaacatagaaaaggtacagtaaaaatatggtataaaagataaaaaatggtacacctgcatagggcacttaccgtgaatgaaggttgcaagattgaaagttgctcttggtgagttgatgaccagtgaatgaatgtgaaggcgtaagatgttactgtgcactactgtagactttataagcactgtacacttagactatactaaatttattttttaaatttcttacctcaaaaatagattaaccttagtttactgtatcttttttacttataaacttcttaattgttttaagctttgactcttctgtaaaaacacttagcttaaaacagaaacatattgttcggctgtacaaaaatattttctatctttgtatccttattctataggcttttgtctgtgttcaacctttttttctacttttaaaattaaaaaaaaagctaagacatatgcacacacattagcctaggcctacaggaggtcaggatcatcaacatcactgtcttccacctccacatcatgtctcactggaaggtcttcaggggaagtaacatgcatgaagctgtcatctcctatggtaacaatgccttctgctgcatacctcctgaaggacctgcctgaggctgttttacagttcactctttttaacataagtagaaagagtacattctgaaatgacaataaaaatttagcatagtaaaatacataaaccagtaatttagtcatttgtacatgtttgtacgtgctagtctttaaatgactgggagcacagtaggtttctttacaccacatcaccacaaacacaggactaatgcattgtgctaagacactatgatggctacgatgtcactaggcaacagaaatttttctgcaccattataatattacggaaacaccatcatatatgtggtccgttgatgatcaaaacacattaccggcacatgactgtatgtataagtacaaattggataaaatatatgtaactttattctatctaaaattatttcccagagtaatgctaagtatttttaaaataatgttctttcacattaaaagtcaatgaatttttgtggtttttgttttttgctaataataattttttttaatttctaacttttaagttcagaggtacatgtgcaggatgggcaggtttgttacataggtaaacatgtgtcatggtggtttgttgtacagattatttcctcacccaggtattaagcctagtacccattagttattttccctgatcatctccctcctcccactgtccgccctcccatgggccccagtgtgtgttggttcctcctatgtatccatgtgttctaatcattcagctcccacttacaagtgagaacatgcagtgtttggttttctgttcctgtattaacttgctaaggataatggcctctagttccatccatgtccctgcaaaggacatgatccccttcttttttatggctgcataatattccatggtatatatgtacattttctttattcagtatatcattgatgggcatttaggttgattccatgtctttgctgttgtgaatagtgctgcattgaacatacacatgcatatgtctttacaatagaatggtttatattcctttgggtatgtacccagtaatgggattgcttggtcaaatagtatttttctctctaggtctttgaggaattgccacactgtcttcaacaacggttgaactaatttacactcccaccaacaatgtaaaagcattcctttttctccacaaccttgccaacatctgttgttttttgactttttaataaacgccattctgactgtcaagagatggtatctcattgtggttttgatgtgcatttctctaatgatcagtgaatgttgagctttttttcatgtgtctgtttgccacatgtatgtcttcttttgagaattgtctcttcatgtcctttgcctacttattaatggagtttttttccttataaatttgtttaagttccttatagatgctagatattagacctttgtcagatgcatagattgtgaaaaatttctcccattttgtaggttgtctgtttactctgttgatagtttcttttgctgtgcagaagctctttagtttaattagattccatttgtcaatttttgcttttgttgtaattgcttttggtgtcttcaacataaaatcttttcctgtgcctatgtccggtatagtattgcctagattttcttctagggtttttattgtcttgagttttacatttaagtctttaatgcatcttgagttgacttttgtatatggtacccagtttcaattttctgcatatagctagccagttctcccagcaccatttattaaatagggaatcctttccccattgcttgtttttgtcaggtttgtcaaagaccagatggttacaggtgtgcagtcttatatctgggcactctatgctgttccattggtctgtgtgtctgtttttgcaccagtgccatgccatttgggttactgtagcactgtaatatagtcaggtagcatgatgcctccagctttattctttttgcttaggattgccttggttattcaggctcttctttggttctatatgaattttaaaatacatttttcttttttttattatactttaagttttagggtacacgtgcacaatgtgcaggtttgttatatatgtatacatgttccatgttggtgtgctgcacccattaactcatcatttagcattaggtatatctcctaatgctatccctcccctctccccgcaccccacaacaagccccgttgtgtgatgttccccttcctgtgtccatgtgttctcattgttcaattcccacctgtgagtgagaacatgcggtgtctggttttttgtccttgcgatagtttgctgacaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatgtgcatctctctgatggccagtgatgatgagcattttttcatgtgtcttttggctgcataaatgtcttcttttaagaagtgtctgttcatatcctttgcccactttttgatgtggttgtttttttcttgtaaatttgtttgagttcattgtagattctggatattagccctttgtcagatgagaagattgcaaaaattttctcccattctgtaggttgcctgttcactctgatggtagtttcttttgctgtgcagaagctctttgacaaacctgacaaaaacaagaaatggggaaacgattccctatttaataaatggtgctgggaaaactggctagccatatggagaaagctgaaactggatcccttccttacaccttatacaaaaattaattcaagatggattgaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggagctaattaaattaaaatacatttttctaactgtgtgaagaatgtcaaaggtagtttaatagaaacagcattggaattagaaatagaaatctataaattgctttgggcagtttggctgtttacacgatattgattttttcctatccaagcatgaaatgtttttccgtttgtttgtgtcctctctgatttcctttaacaggggtttatagttctccttgaaaaggttcttcacttcccttgttagctgtattcctaggtatttgattctctttgtagcaattgtaaatggaagttcattcttgatttggctctctgcatgccttctattggtgtataggaatgccagtgatttttgcatattgattttgtatcctgagactttgctgaagtggcttatcagtttaagaagctttgggactgagacgatggggttttctggatacagaatcatgtcatctgcaaacaaagataatttgacttcctcccttcctatctgaatgccctttatttctttctcgtgcctgatcgttctggccagaacttccaatactatgttgaataggaggggtgagagagggcatccttgtcttctgctggttttcaagggggatgctttcagcttttgcccatccagtatgatattggctgtgggtttgtcatttatggctcttattattttgaggtatgttccttcaatatctagtttattgagagtttttaacatgaagaaatattgaattgtatcaaaggctttttctgcatctactgagataatcatgtggtttatgtctttagttctgtttatgtgatgaatgacatttattgatttgcatatattgagccaaccttgcatcccagggatgaagcctacctgattgtgatagacaagctttttgctgtgctgctggattgtttgccaatattttgttgagaatttttgcgtcgatgttcatcaggttattggtctaaaattttctttttttgttgtatctctgccaggttttggtgtcaggatgatgctggcctcagaatgagttagggaagagtccctccttttcaataataatttttattagtttaactatttccacttcctcttttcctccccccggtaacttgtaggcatacacattatcttgacttctcaagacacgatctcagaattctccattcatcagtctgcaagaactctttgcaacaaaaccatttaaagtctaccagagcctaggtctctggagcattttgtttgcagttgtttataaccaacttccagaaacactgaatgtcaattgcagtatactttgaaaagaagttatttgtcactatagatttcttaccaaatttagtttgttgcaacggaaaggccttttattttaggtgaaaaatgacttctgatttgatttagtcaaagttttaatttaggttttctagtttcattttctttttcctcttctctaatcttataaaaaatatcccactactgcaaaatgtgcctgcttgctataaacaaaagcaggctctaatagagtaaaaagttacaaacatactaagatgtctaattaagatacttattgtaaaattggaaaaaatatttataaaaatagagaattttaaaaaatcgaattgccaagcatttctaagtactcacaattctacattgcacaggagatgtttcactcctgtaactaaattttaaacaaaagaaatgagcttttaatcttgggcacctagaaatagttattaatatagaaaaatacaaagttctataacacggaaccaatatgatatatatggttattggtcttatgttagatcttaagataaaactttttcaaatagatattcaaacagtacaatacactgaaaatttttctaaaaccttttctatttacataacattttatttctgaaagcaaacacacatgccaaaaaggctgagtttaccaaggttacaaaatgaatcagtgaaaggacgaggaatataatttaaatctcagattttgtggtagtatctaatagactcctcatttccattaatttcctaaaatatagtattgttttatagagaaagcaaaagcatttcacattttttctgcagtaagctgttagagtgtaatatctttggagatcaagactccgcattgctcttctaggtgtctacatgaaaaataactgattccactaaagagtagagaggaaaaacaaaactggaatcaagcaaatatgaggacttacaaacatacaaaaggtttatttttaaattcactaagaacactaaacgtgtttctgattctcaattttaaattttgtttttgttccaacaattccaactggattttacacaattggatttaatccaaaactctatttccatttaatagcacggaaactggacctgatatttgtttaaaaggaggccttggcctccttacattaccctttcattgattcacagccttgcactcagaaagtgtataccacaaaatggagatatcccagcaagaacagagagagagagaggagaagggttggggagctggtgtgtcctgtccccttgctgctgacagtgactgtcatacagacaggactcaactctctgtccatttgtctcttttcaccaacctttgccttcaaggccattaaactccctctattcacttagcttcaccaccaccaactcaatgcctatgtcagctatctattgctgtgccacacattaccacgccttggtggcttcagacagcacacattcattatcacaggtttctatggttggaaatctggacgccacttagctgcctcctcggcttcagcgtctcttacaaggctgccatcacagtgtcgacggtgctgctgtctcatctgagggtcacctccaagctcacgggggttttggcaggcttcagttcctcgcagactatcagactgaggacctcaggcccttgctggctgctgcccagcagctgccattggttcttgctatgtgggcttcttgctatggcagcattactctatctgagccagcatgggagagcggcaatagggagagtggcacagtaaggcaagagttaaaatcttatgtgacataatcacggaagtgacatgctaccacctttgctgtactcttatggttagaaacaagtcacaggtgccacccacagctatgggaaggggatcagaccagggtgtgaataccaggaggcagagatcactggggacatcttcgagcctatctaccaggaggcttgagctcaggcccaggtctattggccctagaccagcaatccattatttcagccttaaatcagattcttagaacttcattttggtgataaactagtttactgtttttgttttttcgttgttgttttttgtttttttttggcttgatacctggttccaagagcaccgtgtcccagccttgctcttgatagcggaatacttgcctgcaaatgtttccccctattttctgaatgtatcactccttcatttctcctcgccgtatgttctgttttgggccccggcatgaatacactgcctctcatgcacatttgcagactgcccactgctgaatctcccgcgaggtttttcgacaactggttagttgaatactctgaaaatacgctagtatctttggctaatagtgcttgtagcacatctctatggaccccacagactaacagctgcttttcaatcctgatacgtatttctttgcacagatttcctaaataaacaagtcttattcacatattgtgacacttgccattctcctgacttttaggtcggcctggtttcctgaccttaacttgttctttctgacccaccctgacagtgcctgagctggggctctgatacatgtttaattgccagcaaaaccctttatctcttataaatccctctccagttcgagttccatatctaatcacaacattcacaaggatttaagaaaatacaactacttattgaagcacaaatctataatgatggagaaaataggctttcaaagaaagtatgtttttatactaaatatttaaaactgtcaaactacttattctggaggtttctattttttaacagacaggtcaagtagaagaaaaggcgattctctaaagaacattattccaaaaagtacatctctgtttaaatcatgtttttgctctttcctgtgcctcagataacctcctgtgtcatccatttttacatgtcaaaagcccatctacacttgaggtccatttcactggatacttcctccttggagttttctctgatcaccctaacccaacacagtgagtcccctctctaaacccccaaacaatactcatactggtcgtggggtatgtcatacatactactttttatattctcctttcatgatcctgatgggttgtaaatgtctgtataccaaaaacaatgtatttcttttttttttttttaatactttaagttctagggtacaggtgcacaacgtgcaggtttgttacatatgtatacatgtgccatgttggtttgctacacccattaacttgtcatttgcaataggtatttctcttaatgccatccatccctccccactcccgccaccccacaacaggccccaatgtgcacacgtatgtttattgcggcactattcacaatagcaaagacttggaatcaacccaaatgtcacatatacaccatggaatactgtgcagccataaaaaagatgagttcatgtcctttgtagggacatggacgaagctggaaaccatcattctaagcagactatcgcaaggacagaaaaccaaacaccacatgttctcataggtgggaactgaacaatgaaaacacttggacacagggcagggaacaaaacaacgtatttcttacttttctactcattgagatagattcagtgtcaacatatttttagtaaatttatatgagtaacatagtaatactcaaagttttattatgaatagacaatacccgctttaggagacagagttgaaatctttaatatcatatgtaatttcattaaagatctaaatgtctaatatcttatgtgatgttagtatttattaaatgatattagaaataaactgcaaaactcattttttgaaatatttaccacagttaaatatatcatagataataaatacattttcattttctttgccttgtatcttcctatttcttagtaatctaccagtttaatttgggcatatctgtacccctaaaataaaaaatgttgcatttttgtatgtggatacattaattcaaagtatagtagcacttgaaataccttgaaggtcttaaagcatcacaaagctgaacgttagaatcagtatctgatctgaataaagatgacctctctatggctgcagcatcagctgcaaaagcctcaccaagggggtctgcaggaaatgcggagggcagtggggtgccccagctggatcctacttgccaggaggcactatctctctggtagctgggagtactgatagaacagggctctcagctgtcagtcctctttgaggattgcttcagctaaagaatactgcttcacccaagcccacagctactgactaaccaacatacttactctgtggggcaactctgaaaggtcattctggctccagagctctctgtagattaggctaagtccttcactggatcttcatttcagctcaactgtgggccagtcttgctttcatctcctccctcctacaggtgttaatcctaaaattatttcctaataaacaccctgcttaaaaattttcatctcagagtctgttccccaaagaacttaacttgcagcaaacactagggttgctcttgggagaagagaggatttccacaaagagataaaatgattattctttgctgtttctacctagagaaggttttttccaacctttggtactattgatgttatgagctggataattatttgctgttaagggctaccctgtgcattgtaggatattgagtagcatccctggcctctaccactagatgctagtagcacacgtgcatatgtgtgcacacaagcgtgcacgcacacacacacaacccatgtgacaaaaatgtctgcagatattgccaaatgtcccccgaagggcaaaatcctccattgagaatgtctgccctaggactaattctggcgataggagaacaacaagcaatgaaagaagctggtgcctcccagatgccaggggtagcagttgacaggacacaggtaagcggaggcccggcacaggcagtcaggaacaccttcctccgccacccagcccttgactgcacccccacacctcaccactgggttagctgtgaagagctgagactccataatttggaactagaggtcagtcgatcattttggggggtgcactgtcatgtatggaacgtctttcatcctgctcaatgcatattcactatttataggcttctgaaaggtgtcacattctcttcagtctttgatgaaaagcaggattctccaattccacagagaagctgtaggttttagttgtttttttttcctcttcaaattcttgaagtgccagtgttcttaaaggctttcctgatctgctttaaatgtcctgggtatgcatttaagtaagagagacacttccttcacatataatctcttcaattgcaggggaagctagggtattgggattctagagaatttccttcactcttgaattcctcgatttacatagaaaaagctggagttgggggaaatgagatgtacaattgaggcagaaggaagtatcagagctatacaggaaccagcataaacagaatatctgtaagttgggacatattcaaaatactatcactaagtgctccaattaccactactactattattgtcacatttccatccacatactttttttccttcttttttctgttttttaatggaagtatgattgatatatgaaaaagcagtatatatttaatgtatacatcctgatgagtttggagataagtacatatctgaaatcatcaacagaagcactgccgtaacgttacccgtcactggcccaggttcctgcctccctctctttttgtgtatataataagaacatctaacataaagtctaccctcttcataaatgtttacatatataatatggttttgttaactatatgctctatgctgtgccgatctccacacttattcatcctgcgtcagtcaccctagggacgcttagattgacatctatctgctgcccactccccccagccatggtacccaccattcgactctctgtttctatgaatttgactattttagactcgtgacataaatgggatcatgtactatttgtcattttgtgcctagcttatttcctttagtgtcctccaagttcatctatgttacaacaaatggcaggatctctctttttttttttttttttttttgagacagactttcactcttgttgcccaggctggagtgcaatggtgcgatcttggctcaccgcaatctccacctcctggttcaagcgattctcctgcctcagcctcctgagtagctgggatttttttttacaggtctgcaccaccacgcccggctaatttttgtatttttagtagagatgtgatttctccatgttggtcaggctggtctcaaactcccgacctcaggtgatccacccgcctcggcctcccaaagtgctgggattacaggcatgagccaccacacccagccttttttttctttttaatttcaacttttattttagactcagggggtaaatgttcaggtttgttacactggtatattgcctgatgctgaggtctgcggtattaatgatccatgagcatagtaactgctagtttttcagccctcactccccttcctccctttctttttctggagtccccagtgtctgtgtttgtcatctttatgttcacaagtgtccagtgtttagcgcctacttataagagagaacatgtggtatttggttttctgttcctgcatttgttcacttaggataatggcacccagatgcatccatgttgctgcaaaagacatgatttcattcttttttatggctgtgtagtgctctatggtgtgtaggcaccacattttctttgtccaatccactgtgcatgggcacctacgttgattccatgtctttgctattgtgaatagtgctgcaaagaacatacctggcatgtgtctttatagtagaatgatgtattttcctttcgctgtacacccagtaatgggattgctaggttgaatggtagccatgttttatgttatttgagaaacatccaaactgctttccacagtggctgaactaatttacattcccaccaagagcatataaatgttcccttttctccacagcctcaccagcatctgctattttttgactttttagtaatagccattctgactggtgtgagatggtgtctcattgtggttttggtttgtatttctctgacgataagtaatgttgagcagtttttcatgtttgttggccatttgtatgtcttcttttgggaagtgtctgttcatgttctttgcccactttttaatggggttgttttttgcttgttcacttgtttaagttccttatggattctggatattagatctttattggatacagtttgtgaatattttcccccattttgtagggtgtatgttagctctgttgataatttcttttgctgtgcagaagctctttagttaggtcccacttaccaatttttgtttttgttgtagttgtttttgggatcttagccataaattccttgccaaggctggtgtccaaaatggtgtttcctaggttttcttctagattttttaaaagcttgaggtcttacatttaaattcttgctccatcttgagttaatttttgcatacgctgaaaagtaggagtccgggtttaatcttctgcatttggttagccagttatcccagcaccatttactgaataggaagtcctttccccattgcttattttagtcaactttgtcaatggtcagatggttgtcgttgtgcagctttatttctgggccctctatactattacaattggtctatgtatctgttttttgtatcagtactatcctgttttgattactgtagccttatagtatagtttgaaatcagataatgtgatgcctccagctttactctttttgcttagggttattttggctattttggctattttttggttccatatgagttttagaatagtttttttctaattctgtgaaggatggcattggtagtttgataggagtagtgctgaatctgtagactgctttaggcagtaggccattttaatgatattaattctgccaatccatgagcatggaatgtttttgcatttgtttgtgtcatctatgatttctttagtagtgttttgtagttctccttgtagaaatctttcacttccttagttagaggtattcccaagtttttttttgtagctattgtaaatgggactgcattcttgatttgactctcagcttgaatcttattggtgtatacaaatactcctgttttttatatatactacattttctttatttcatcttttcatggacatttagattgtttctatgtctttgctactgtaaataatgctacaatcaacgtgagagtgcagatatatcttcaagatcctgatttcaattttgggaggtttatactcaaaagtgggatggctggatcatatggtagttctatattaaattttttaggaacctccatattgttttcaatagttaatgtactaatttacatttccaccagtgtacaagagtgcccctttctccgtatccccaccaacacttgttgttttttgtttttttgtgaatagccatcctgacagatatgagatgatgtcttgtggctttgatttgcatttccatccacatattttttaagaataaatagaaaaaggaggtgcttttatatatgtgtgtgtcacaaaaggattatatgcaaaccaactgcaaaatacaaatgctgcatttcagcactgtctttaacctttgtcttaatttttgaatttaagattttacaatagctataatttattttctgttaaccaacttaatttttacatgcttactaatgcacctttgtatcatagtgtttagcattagcaacactgtgggagaagaggcagagaaaatatccatgaaatacaggtaatctttaattttatgagacagtttcttcccatgaagaatttataactttctcagctctaatcaaattccctgccacaggagcacgttctaattagagccatctgctcctagcaggatattcatcccaggccaatgtatggtgaaacattctaatccattttaagcatctaatttgtttctgcactaaaattctaggcaaagagcagctggatgtcattggagacttttcctgcacaatgagggcaaggaaagttaaaacagaaattcactgagtggaaaccacggatctgtaattaggaaatattaatctaggacatgcagtgataaaaatcaatgaccagctgctcatatcatgcttattgaagtagttgaccctagaaaaactactaccatctcatttgttcataggcttttcgccactcctttttttggatcaagagacatggatttattcatccatccactcatttattcattcacactaccaccattgacaatttttgagcaaggcactgtgctttgtgctaaagacaatgggtacagatgtaagtcactgatctggttttcaaaagttgatagacagtgtaaaataatttcaagagtgttttaaaaggtcattttaaaacttatcttgggggcagaaaggaaataatgtatgcaatagtctatttttgttcctaccatacatatagcaattaagtgtaagtattatattattccctccagaacttgtatattattacataattacaagaattgagatatctcagatactttgtaaggatggtacatctttgacatagttgtttatattcaaatgccaccatgaaactcagagtagatacaggagctataaaaggagaaaaaaaaagactattcaaatttccattaattggaaatgattttaaaggaaaatgtaaaataccaattcaggtgtcaatgaatgactcctaggggacaagttaacacacacagacacacacacacacacacacacacacacaatcagaagctacctcctgttagagtctatttttctattggattttaaaatttctactttaagtcacaattaaatgcaaatacttaacagaactgttcttgagctcttcattgctaatagcctctgctgattttgccctcttcttctctacccctttgcttcagctccagtttcccaaatttctgtgacggggtgaaagagtacactgagagagagaaaaacaccacacctccggaagacaaagggatgcaatcacctgatccagaggagattatttctttaaaaaaaaaaaaaaagtcacacacacacacacacacacacacacacacatgcgaagctttgcatactgaagtgaacaccaacagtttcagatttcaaaacgaatggacccatgtgcacacgggcacatagacatacacacacacacacacacacacacacacacacgacatgatttatttcagcagagcatcagaatgcaataataaccaaaaaggtatcatatattttacaattattctctattaaatgtggaaccaagattaagctctagtgacaaaaaaaaaaaaaaaaaaaatcctagacccaggaccagagcagctggtggctacaggtaatgtcactgaagtggttcagctatgacagaggctcaggtgtagactgctgagcagaaacatccttgtgggtacagacgcgcttccactggtccgcaaagaaacacaatccaccaatttcaaatgcaagttcatcctggaagcaaacctcagaactacactgatgacataatcgatgcccacattaagaatggaggcccagcactaaaggaaagctgtctctaaacaagtcatcacagaagcatatctgtgattattgccagtaatactttgtcagccttaattcatcctttctatcacaagagcctatagtaagagacttagcctgtaaacagttgactctgagctcatttcaaatcagcaacacataggcgagagttataaataatgcatgcagtgatgctgcagaatggtttgggtgcatgcagaatgaatgaccgtgttgcatacgtcttaaaaagtgtcgatttacttttgttcacaactggatagtggctaagcatagacatttgtataaatattcgccaagacgagtcttccaacaaaccatactaattaggatgctgtaaaataatcgcaaaccaaaagactgctgaatagtttacaggtagggcatatgtgggccctaggacaatgtatattctatttggcatattcatcatggatttagaactaatagagatcctatctttttagtgcctgaagtggctaaaaaatatcttcttaagtggccaagcgtggtggctcatgcctgtaatcccagctctgtgagaggccaaggtgggaggatcccttgaggccaggagttggagagcagtctaggcaacatagcaagaccccgtctctacaaaaaaaataagaaaattatccaggcatgatggtacgtgcctgtaatcacagctattcaggaaactgatgcaggaggatcacttgagcccagaagttcaatgcttcagtgagctatgatcacatattttatacataaaatatgacatattttatattcgaggatatatataatatatatcttttagttatcttgatgggaatgggtggtttatacttcccaaaacccaataagatatttaaacatgttttttcatgctgaagttatttatttactgccatgttcaggaaagtatgatggaaaagaaataaagagaagaggagaaataactatctttaaactgcctcccaagattcacagataagctatacaaaaactctaagctctggcctatcaacgttgttggtgtttggggatcctttttcaccagctctactttaagcttctattaagcttgccaaattgatttcagatttgttatacgcctggcacagcaggcactatttaaaatgtatgttcctggcagctgaggtggggcagtgccgtccagtctcaacgtcagctggccttgtttggcaccttcatcacatgtacatgctcctattaatctactgtctaacaaagatctggaaaagcctagtatcttcccatattaaagccagatcattaaagaaataccacttgagattgtatagaagggcaagaaaataattcttaatttctaaaccaaattggtttcatagaaattctgcctttggctgatcacttcactttagtagagcaaagcaataaatttttatcccttttcactgaaacccttggttatctctgcaccagggaagaaaataatgtcttctattaagattaatattgttatgggaatattactatgattattattataaattcacctccatctttgcttgtttgcttgtttggtttgcttctttcttctttgaatacaccatacctgaggaagcagaatcacatggctgatgatatcaaactggcttaatgtaattatggactagttgtgaataaaaatatgtactgaccgcttattatgtgaatagcactgtgttaggtaaataatgtttttcttttacccaatggggaaatgatctcttcccacaaagagtccagtgattaggttgggtaagaaagccatagccatgaaagaattaatgaacagaagtgtgctctagtgcagagtcatttctactgaaagcatcagagaggcttcgcagaaagattggaacttgaggtgagtcaggaagtttcataaaagatggataagtaggccaggcgcagtgcctcacgcctggaatcccagcactttgggaggccacggcgggcggatcacgaggtcaggagatcgagaccatcccggctaacacagtgaaaccccgtctctactaaaaatacaaaaaaaattatccgggcgtggtggcgggcgcctgtggtcccagctactcgggaggctgaggcaggagaatggcgggaacccgggaggcggagcctgcagtgagccgagatcgcgccactgcactccagcctgggcgacagagccagactccgtctcaaaacaaaacaaaaagaaagatggataagtagacagaggaaggaggagctggcttggcaccaagtctaaggtatgaaagaacatggtttgtaatataggaaagcacaatctatttataatacacacatacttaaatatttaaaattgattcaacaggttaaagaccaggctttgccaagagtagataccagtattcctatggtttggtctttcaacgagtagactctttgaagtgtttcaatatattgtatttcccaccgatggagtttaaaaagaaagggaaagaaaaacagtgcaaatcgattcctgctgacaacaacacctacacgttgctctttgggagtaactgttttccaagttgtaattaggatcttttgtccattctacgtaaggtatggtaacatcacaaatacaaaactgcagtggattttatattttaaaatataaataatgaattagatgtcatgatgaccagctgcttagctgattttaccactcatggctatttgaccgggttcagaagggcaagagccattaacaagggtaattacctcctgcgcctctctcctcttccgcagaccctggcctgtaataggtgccattccaggcactccctcagtgctgaatgaatacataaatgaatgaattgtagatatggcttcagataataaggaaattcaaactactgcatgctctttgcccaaaatgactgtgtggaaagaaaataaatactgcttctattaagatattccttcattataggaggtcatatgagaaggttgggagaagaagggagaacgatagtaataacaagggatttctcttcatctttaatgctaaggatcaaagacctttctcctatttgaggctgactgcatttgcattgtacacctttagatgatgaataactagacatgttgtgtgtatttatgattgtgggttaaattttaggctgtgaattctgatgtcaaaatttagaagcactgacctctacttattcatgtattggtaacaaaaagaactttccaaagttttccaaatttggtatcaccttagaagagctaacctcattttacacttgaataacccagtatttcattaagcacttaatatgtatggagttcagttagctattgttcagtaatccaatagatgttattgatttttgggacttatcttgggggagataattcagagacaggacaggacaagaaaatattaaagagttaattaactagacagtgtaacacacatatagtaagtaccatataagtcaattaaatagcattgtaggacttaaggaaagtaagaatcactactagtgaaatattcttggatgacttcatggagaaaaaacaattgtgccttcgaagaagggtgtgatttagaatgttgaagaagaaattcgagtgtgtttcaggaattcattcatagcatgaagagaattaccaacagccacgacatgtttagagcaaaatgcagactccctttgataagggcggctgttcttatgggagtggggaagttgatagggaaattacagtttcattcagcatgtagagagccttaaatgacagcctaggcttttaagacaattccgtaagctgtgattggtgatatgataaaaggagtcattttaagaccatttatctaatgcgtatactagtgtgcaagatacgtttaaggtgggatgtactagaggcaggaaaccagctgagaagctaagagccaagcacaggaccctaacagccacagctccagtgacagcaacaggactggaaaagaaagaatggaagagtgacagttcaaaaagagagatcaggctgtgtgtggtggctcatgtctgtaatcccagcactttgggaggccaaggctagctgttcacaaagtcaggagatcgagaccatcttggccaacatggtgaaaccccatctctattaatatacaaaaaattagcctgacgtggtggcatgtgcctgtaatcccagctacttgggaggctgacgcaggggaatcacttgaacccaggaggcggaggttagagtgagctgagatcgcaccagtgtactccagcctggtgacagagcaagactccgtttaaaaaaagaaaaaaaagaaaaaggatggaagagtgacagtttaaaagagagatcaggccatgcaccgtggctcatgcctataatcccaacactttgggaggctgagtcaggtggaccgcttgaacccagaatgtggaggttgcagtgagccaagatcacgccactcaaaaaaaaaaaaaaaaaaaaaaaaggaaaagaaaatcagtggcactttttgaccaattggacttgaagagaggttctaaaggtgatttaaaccaaaacaactacaaaaatgagcccagaaataaaggcaattcatgtacaactcagagagttggaccagctgaccactaaggcctcaaacaaacaaagttccactccttgtgtctgcacaaattatgttcctctctctcccctttgcctgtccagttatggctgtgtattaagatctatttcaaatctctccactccttgaaaaactgcatgactactccctgttatgtgcaagatcctccttgggctcccgatacattcacttctcttccacataatcacgtgtgtcattgcatcctctttttgctacagtaattcttttccctatcaatccctccaccctcactagtttttattctatcttacaaaagctagcactgaattaaatatgaactggtataaaacacaaacttacagctagaggtaaaaaatcttaataaatgcatctcttttactagaccactagaaatgttaatacccaaaggatacagggaagcctattggcactgaatattcaaaaatttaaataagctcttttgaaacttgaagctgaaagtctttctagatattcaagtattatctatggaaataaatcaagaagccctggaaaagtgtggcaaacaccttccattgctaaaggaacaattaaaaagcctattctaagaggcacaacggagctaaccattttctatgtcgtgcaagcggaaataattcagtgatgtctttgtgcctctcagaaaatcacacaaagtcactttctgctttttagtttgctctttggccctatgtaaaatgttgccacagaaattgctttgtgctcagcaaaaactcaacctgttaaattccagtgactggaatcattgaaggtcaagaggtaaaactcacctgctgtgccacattttcacaattcagagggttcttctgcactcagcatttatgtgatggtttctttctgtggaacatgtattccattttcaaaaggtctagtcttgattaacttgtacttggttaacaaacatgtattgagagtcatttgggttctgagcacagtattaagggatttggaaaagagaaggtaaaaaaaattgtatacagagaagtcaacttaaaatcctgaaatagcaacaaatataccaaccttgacattgtagtttataaatccattttagaaaaacaaacatattgcagagagaaaaaaacagaaatgatgatctataaaacaacatatattttaaattaagcaaactagaacatcatgaaaatttcatcgtatgggctttaatatgagaacaggaatgcaatcagtactgaaaaaaggtcaaaagaaaaatctaaaggttcatttaaagcatagagcagaaaattctctgaaaatgttttctctatatctaaaatgataaatttcatcaaatttgaaatttgggtaataaaaatggactattcaatgataacattttcaaaatactttataatgccttatttatattagatctttgttcttaagtaacatcatgacaaatacgtttttctaaaatatacagttataataaattaatggcaaaaagtatgaatattgtcatagttatgtcataacttattgtcataagttaagtgggctcagactgctgggccttttatatgtcaatttccagcatttttgtccactcatagtatttaatggttaatttgccattcactgtagcctactaagaactaaatagtgcaaaggaaaatcatgttgttaaatcaattacatgacaacttttaagaaaaattcacagtcaataggctcttttctgagagcctgtgggaggttctgtgagtcctctatagtttctatctgtccattactatgtgtccaatacctgccacatcactggcaaccaatttaattgataacacaatgataaataaataaagcatatatatttgtgacttttttcctatattatttcaaatcttccatttatttttaagtctatgtctgcttggaataggttaaactgccaaaagtttgaatgccaaagtaactgaggtgctagctatcatgtgcatttttgatatttcatactaaaattaaacaaattttctttgtaaatttcttttcattgaaaaaaaatatcatgggatgacaaagatgttttgttccagtatcaaattctctttctttgtctttatttgaactatagatgtgtatagcaaattcaactttgaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaattcaactttgaataaaaaaagttatgttcttttttgcctcgctaagtattagtagcaaatattcaggtatagctaatattttcatgcatcaaacataaattagaaagaaatagtgttcagtataatcaacaggttcacaggaaaaaaagaaagaaaagaatggtgtttgattttacccatgtctggaaagacaacatcgtgttctggaaggctctctgatgggaagtcagaggtgcagaagtgcaggagagctgggaaacaggttgcaatatactgtgagatcctttagtttgtaaaacacaaaggctcagattgcagggaagatattaagcttcacatatttcatttgaagtgtttttacatttacctcctgtggtaaaatggccatagcatttcagggcaaacgtccttgatgtgaatgggagtcccagtgttgagtgctaccccacttctggcacacactgtatttgtttccgaagaatcaagcttgtgaggagagacaggacatacaacctagcatgtcccggggaagccgactttgtcatatatacacacacatatatatatatgaataatataaatgaatactcacctcccctaatgtgttcttttataagctaaaatttttatacaaagcaaaatctcatgggatgtcacttgaaagaaaaacatgttttatgaaatcaagatctctagaaaaaaagtaagtagacatcattaaaattgttctagtgatttttttcaaaatgatcagatatgccatttgataacatccccagaagttaagctattagaggatttcctgaaaaatgattaaatgttacccacttcaccaaggatataaatatcttacactttcaatcaatctttcacgcttttattaacaactcataattataattctttcagtgcttatgactctcccaacttgataaataaataaattgaatgtatctgccctgccctgaggtcaaaaatactggtgtgcacctcctcccttgtaagattcttgaacccacttaatgactctgcactctacatgtgggtcttaggagggactcatcatcatcactgaatggaccgtcaatgtggcaaaagctcaagatacttttggaagtcaatatttcgatactaaaaccaatatttaaaattgaaatataatttacataccataaaatttacccattgaaagtgtacaatatagtgctttttagtatatccataaggcattacaaacatcaccactatcgagttccagcacagttccatcaacccagaaagaaacaccctaggccgggcatggtggctctcgcctgtaatcccaacactttgggaggccgaggcaggcgtatcacttgagctcaggagtgcgagaccagcctggccaacatgatgaaaacccatctctactagaaatacaaaaattagctgggagtggtggcaggtgcctgtagtcccagctacttgggaggctgagtcaggagaatcgcttgaacctgggaggcagaggttgcagtgaaccgagattgcaccactccagcctgggtgacagagcaagatcctgtcaaaaaagaaagaaaaggaaggaaggaaagaaggaaggaagggagagaaagaaagggaaaggaaaggaagaaaagaaggaagggagggagggagggaaagaaagggaaaggaaaggaagaaaagcaggaaggaaggaagcaaaaagaaacataatccccattagcagtcactctgcactgcctctcccccagccctggcaatggctaatcaactttgtggctctgtggatttgcctattctgtacaccaacaccagttttgaaagagaatttttttcattagttcacttggatattttgtgctgctctattttctttcttaaaaaaaaaaaacatctagaggataaggaaaataaaactttgcagatttttgtcaaatactattcagtagaaggattattttcttaaggaaataaaaaatgaaacttagattcctgggcttagtctcttggaattcattatttcaattattttgttcatgctaccaaagaaaccttcttttttttttttttttttttttgaaacagagtctcgctctgtcacccaggctggagtgcagtgacacaatatcggcttattgcgacctccgcctcccagattcaagtgattctcctgcctcagcctcccgagtagctaagattacaggcgcacgcccccatgcccagctaatttttgtatttttcatagaaatgaggtttcactatgttggccaggctggtcttgaactcctgacctcagggaatctgcccacctcggcctcccagagtgctgggattacaggcatgagccactgtgcccggtctcaaataaaccttcttgaaaaaattatattctcataggaagcgcattagactaattatattttgtagataaataacactaaacatagcttacatataaaaatttctttgcttaagaattaaatgaaataattctctggaaaacattcaattactagatattttagcataattgctcaattttgtgaaagaatcaaatgcacatttgtccttaataatatgaagaatggaaattcagttttctaaactatctatattttaattaaaagaaattcactctctttgtaataagataataatgcggtattaaaataaaagcattctcaatagtaaaatgtttttgctgactagctttgttaataaaactatgttttgaacaatcactggattaatcctagtgacaatgtgtagagttttcaaaacaggaacattaacagactcttgtcccatagtcttggtacaatggtaggagcctggcttaaggtagatgggctagagagaaagagagggaaataggagattgtaatgaaatagagccaaccaaacgtgttaaattttacacaggagatgaggaaaacttcaagatggtgccataatttcttgcttgagtgactgcccgtggaagacagaatttatcaacatagaagatggggaggaattaagatcttttcttactgaaaagatcctaagtttggagcgttttgccctgtagctatttaactctcaaccaggtatttggatatacaagtttattgttcagagtaatagaagctagagaaaaatattggaaatggtcagtataaaacttgtggatagcagaaattctggttgaaatcacccaaagtgtttaaagaaaatagaaggtggttaaggacaaaactgatagaaagagaaggaaggaagggaaggacaaatggagacctgaaagtttctgaacaaaacagggaaatcggagaaaacccaaaagactgatgtggcaaaaaccaaagaactcaagttttaaaacagagcactggttaacagaaatgaatgaagcagaaatattcaatataagcaggactgagaggtgaatattggaattgcctatctggatatcactagaagaaaggtttcagcagcaagggagatgctaagccagcagttagacgcttgaggccaatgctgctaagctgaaaatgtgcacttagaactgattagtatgtagacagtatttggagccattaaatcagtgtgagatgacttggggatgagtgtgggtaaagagaagagaacctagaactaagaaagagacagagggggaaccagcaaactgagaaggagaggccagggagacgagagggacaccaacagcttgtggggccctgataggctttatgaacttgagtcaaagaggaccgggtggtcggctgtgtgaagtgctgccaccagatgagatgggcagttccactggaattcatactgcggaggttattggccatgctagggaaatgcctaacaggagccactcaaaaacatgtcaaagtcaacaaaggtaaagaaagcctaaggaatggttccagattaaaggctactaacaggacatgataattacatgtgacatatgaccctggactgcattgagatcactggcaaaatgtgaatgtagactacatattggatagtaatgtggtatcaatgtttagttttctgattttgataactttactgcagttatgagagagaatactctttttcttcggaaatatacaataatgtgcttcagaataaggggcatggcgtctccaactcactctcaaattactcaggaagaacgaagtgtgtgtgtgtgtgtgtgtgtgtgtgtgtgtgcatgtatggatagataatagaataataaagtaactagagcaaaacataaacaaatgatgagtctgaatataagctatagaatagtttcttgtactattattttaacttttatgtataatggaatgtagattttagaaattacagaaagaaaatgaggagagggagaaaaagggggagagcaattggaaaaagcaagtctaccaactctcgtaaaataaacacctgcgctctagagaaaagtaaggaaatggggtgggaaatggtggggaaggtaacatcaaaacaagattagggtttttttctccttacctgaccaaaattacagcacagtggcaagctgatgtcaatatgccagtggaaagagaaaaaaggttgaatagcagagaaataggggaaattgctggcatgatttcctttcatgaggagaagagggtgagtctgcatacaaatggagaaactggctctcctaggagtagggaacattcatctttggtaataagcagaaaaacaaagcatgagaatgcaattactggaaggtagaaaaaagagataaagagtgcctaccccactttttgccctgggggacctggaaagcacctcccttgaatggattcgtgggaagtagtgtttccaagggacaaccaggtttcagtctgagcaataaggtgaaaggaaagttcagagaatatcctaacaaatggcagagcttgcatttaagaagctatatacggagacacatggaaaatccagccatggtagtggatatacagatagcacaaggttgagggcctgcgtcatgatggatggcctgtgtttgaaatgctttttccttggtgtcataaagaaacagcacttgaacataaatttaattttctcagcaaggccatttcatactttctgcagaaagggtacagcagcagcagttttgccacaacggcacaccgaacaaaccggagacagggtcatttataacctgatgcatccaccctactgctgtgtccggtttccattggctggaatggggcctcacattctgtatttgtcctgattggctagtaacttagaaaatttttaaaaagacaaaggcagaggagaacaaaggaaggaggaagtaacttgtggcatgctgagaaaggtaaaaacaccttcaaataaggaagaggaacaggctatggcctaatgcttgcttggaccagtataagcatgccagggcaaatatttaggctaaactgtgggagctaagaacataaagtacattgatttctttattatggatagcagatatttaagaatgttagcacaggtctatgaataaattttgcttctaagagaagttactatgtattcctaattagatggggaggaaagtctttgaagaggaacctctactttactttttacacctgggacctggtttctgggtgaatgagggaatgaaggatgtgagcataatgagctcagtgctgattatttcctgaagagaagtgggcaaccagttcaagacagatgttatgggtccactggctgaccatgctttcctgcagaagccagtattacggcaaccaaggggagaaagagagtctccataacaattaatcttcctggaagctgaagcaccaaatggtttgagtgtttcttcttcttaaagggaaggtagtgtggcccatatgaaaagggtggcccattgtgaagcaggaggctagaaatgggctcttctttgtgggatgaactgtatagcagctggtgtgggagctggagcataagtggcttagaggcagcttcttctctccagcagcgggcaggttggctctgggatcacctcagtcaatggcgtcaccatccaattcaaagataaggatggaagcagttataagtatgtttgtacaggcttaattttctctggaaagtaggaatgggtcacctgaggataaaagggggaagtgaataaagtcgggggacagaacatctgaggtctcaagggggattcatgagattttggatcaagccactgagggcacatcaaaggttcatggacgaagacatggaagaattatagaacagggcccagggcccacccagtgttggagtttacaaatcagtcactacatagtggtcctggatctgttgaatagtagactcttcaaaacacactgataaatccctccctcttaaaagctgaagaattggccctctctgaaaaccacagcactgtctcgcattatagggattaacccaaactgctctgtgaagctcgtctaatctatgagcaatgagaaaggcagaagaatttgtaataataaagaaatgaaaactgagctgtagccttcgattacactgtgacatttggtgagttcactgtctttctttagtgtaagaatcaaggaacaaatttgttttattgtttggcgtattatataactcatttgacagtactgcttaagttatacaacaacccctaattcatatttttaagctcgtttgaaaaaaaaattaaaatgctctcaccttggagcattactttacattttgcagcacacatttgtagtttgggttctttttaggcagaaatctgaactaacaagtacttctattttttctccagattctttacatttctacagctttatttcacccttttctaacataataaaccatttctcagcaaacatttagataaaatgtcacagacttggagaaagaaaatctaaattgcagatcaaaaacaaggccatattaagcatgagaagtggtagtgggaatacaatttacaatgttttgatttaataccataaagaatgtccacagaatagactgcaggttggaattcgtggagatgtcttctttagtttatgtaatgaatgccattcttattcagtaagatttaatcaggctacttgagactgagatataagtgtagagaagatattggctttccttctccatatacttggaatgtaaaattacttaggaaattttacactgacactacatggtgaggagatatatatatcttaaatatatatatatatatttctttttaagattaagtatgagacctcaaaaatatttggactgcaaatactattttaaagtaataaaatattatttctgtgaaatagaaactaaaattgaaaagtgcttgaagtataaattctattaaattttagtgaaaaaatatcaagaaaatactcatcatataattaaaaatttattgtgtacaaatgggttctgctatttctaatatattttattatcaatgtattatattctgttatataactttatgatattcatttaatttcaagtactagattttgatatactactttaccatattttggtttctatttccttttatagacaggttcactccctaccactaaaaatgtttaaatacttaatttaatctgagacaacatctgcaacaaaaaaacagaactgctgttgtaagtttctgatattatatgtaaaatggcataacaatataattttatttgaaggtagactgtgttaacttaaatatatatattatcaatcctagagtaaccactttaaatataaagcagcatagctaatgagctaaaagaagacataaaacagaacactagaagataaccaattgaaactaaagcagaaaataaagagggttgaatgaagagaagatggcacacacagaaaacaaatagcaggatagtagatttatacgcagccataccaataatcacagcagatgtaaatcatctaatatttcaattaatagtcagaaattgacttccaatttctagtccggcataaaaggaacctgaaaatcatcactgtctcctaaccataagtaaaaagctgaaaaacttgataatcaacaagtcttctacatctatcagagaagtgagctcataggacaaactgcagccctcaaaactgaagagacactagtggatacagacaggtcccactcaccagagcagaaacctcatgggaacgaatactaggctaggaaaacctgaactgtaatctatacattgcacgaaacctcatgggaacgaatactaggctaggaaaacctgaactgtaatctatacattgcacgaaacctcatgggaatgaatactaggctaggaaaacctgaactgtaatctatacattgcgtgaaacctcatgggaatgaatactaggctacgaaaacctgaactgtaatctatacattgtgggaaacctcatgggaacgaatactaggctacaaaaacctgaactgtaatctatacattgcgcgaaacctcatgggagcgaatactaggctaggaaaacctgaactgtaatctgtacattgctacaggcttgatttggacaattctgagagttaaaatcggggtggggcagttttagggggacctccacacttttgagttttacctctagcagcaccaccagagtctcatagtgaaggttagagaagaagtctgtcttagtctgtctggactactataacaaaatactttgaactgggtgatttataaacaataaaaattgttcactcggaggctgggaagtgcaagaacgaagtgtgggcagatccagtgtctgatgaggacttgctctctgctttgaaaatggagccttctttctccatctccacatggtggaagggcaaaaggactccctcaagctgtataaggatattaatcctatttatgaagacaagccctcatgaccttattacctcctagaggccccaactccgtaccattagtattagatttcaacacacaaattttgggggttcagagagattcaacaatagcaaaactcctcatgcttttgacagagagagtagaaaaataactactttgaaatatgcccggagcattctgctctttttaacaaggcgtgccctcaaaaggacgtattttaccacagctagccccatctggcctttgacatggagtgaaaaaaaatacacaacttcagactgctctggccatcctgtcccacctaagtggaaagaagagagagactccaaagcatttgcgaaggtcacagcacaggaacacaagctcattaaaagactggaacctaatcatcggactacaggacactttccctcccactccaccttcccgccacatcactaatgacctatctaccacagttccttctacctgcatgttcagctttcaacaaaagttacaatgcacattaaaaagtagaaaacaggccaggcgtggtggctcatgcctgtaatcccagcactttgggaggctgaggtgggcgtatcacaaggtcaggagttcgagaccagcctggccaacacggtgaaaccccatctctactaaaaatacaaaaaaaaattagctaggtgtggtggtgtgcacctgtaatcccagctactcaggaggctgaggcaggagaatcgcttgaacctgggaggcggaagttgcagtgagccaagattgtgccactgcactccagcctggggacatagcgagactccatctcaaaaaaaaaaaaaaaaaaaaaaagtagaaaacacaatctgaagagacaaaacaagcaccagaacaaggctcagatatggcagggatgttggaaagttagagattgtcagactggataaaaaacaaatcttaaatccatgctgtgtgcaataaactaattttaaatagaatgatacatataggttaaaaataaaaagaaagaaatatcatgcaaacactaatcaaaaaaggtggagtggctatagtagcatcagagtaaacttaaagacaagaaatactactagaggtaaagaggaatattccataataaagaagtcaattcatcaagaaactataacaatcctaaatgtgcatgcatctaataacaaaacttcaaaatcataaaacaaaaacaattgaaaggaaaaatagacaaaaatccatatttacattggatagtttaacactgttctctccacaactggtagaactagtgaactatattcactaagaatatagaaaatgtgaacattatcaatcaacacatcttgactgatatttgtacaaaataacacctaacaacagcatactgcacactattcacatgtgctgtggaatattcacaaagacagatcatttgctgatccatgaaataagtcttgagaaatttaaaagaattgaaatcacttcagaataggttctctcaccacaaatgaattaaactagaaatcaataatgaaaaaaatatctgggaagccccaaactatttggaaattaagcaatatggttacaaataaccaagcaccaaagaagaaattaccagagaagtcagaaaatactttaaccaatgtagcagtgaaaacttaacatactgaaatatatggatgtcagttaagcaatgcaatgctgagagggaagcttgatctccatatggttatattaagcaccgtgaaaacaaataactataatatactaaaacagtatttattgtttttgtttgtttgtttgtttttttggcgacagagtctcattctgtcgcccaggccggaatgcacatggcagcaatctcggctcactgcaacctccgcctcccaagttcaagcaattctcctgcctcagcctcccgagtagctgggattacaagcacccaccaccatacctggctaatttttgtatttttagtagagatggggttttgccatgttggccagtctggtctcaaactcctgacctcagatgattcacccacctcggcctccaaagtgctgggattccaggcatgaaccacagcacccagcctaaaacagtattttttgttaatgagggaccatttaaaccttctctacttggaaggggcagggaatgaaggacaggtatgaggctcaacacagtaaaacctagggacgggggcgacatttaggctggacattgaaaaatgaagccagatgaggaatttctgtgaggcaggagcatgaggaaaggcagggcatgctgtccctgagatgctgtggatagaagaggtgtcattccagtgtggccggagggtaagatttctggaggaaagtgagcggggccgagaacatcaagctgagcgcgcaacagattgtgaagggcctcgtatgctctacatgtacatagaagtaaatgtgtgagtcagaattccttctgtggacatactcaacaatattctctttttgcttctctaaaggaaaaataactgactaatgcaacagtcagctcaatatgaatcataactattgaaaaagagaaagaagtttgatgaataccaaaattaacagaggcttttccatatgtatcctttgggtagcttcccagaaggaagaatcaacacagctacttggcaggtctacctaagctagccccagtcacacttcttcacaaactccagctggcatgcaaagtgtgagaaaacagcccagctaaaacacagtactgaaaagtcttgaatttacaaacaaaagattgctattaaataaagaaaatagaaaacaaaacacagcactgtgttgtgactgtgaggaatacttttgcaccagaagatataaaatgtgattaaacaggcgttgattgatttgggttcggtgggtcaaggcctctccctggatttgaacatttcagagtccagactactgactggctgtaatatcaaaacactgtataaaatgcttcgatttgtaacagaatttaacactgtcagaagtcataaggcagttttgtttttcctaattcacaattaagttataatagcagcaagctgactttactcagtcacagagccagaggatttgatgaggtgtacaattttccctcaaggataaaaatgtaattatgaaaaagtcctgaactgaaaaacagtattgtcagctatttccaagaaagataaaagatcatttaaaggtaaagagattacagataaaaggaatacaaaattaagttgaaaccaccagggtagagagaacaagttctaaacaagaaccaaacattaaaacattttattataacaagaaaatatggctttcgtttttctaaaaggacaataagtttttaaattcatgtctgattagttcatccagatgtttaaagataaatagatatcaattgatgattatactttccatgttgctgataaatagatatcaattgatgattatactttccatgttgctgataaatagatatcaattgatgattatactttccatgttgctgataaatagatatcaattgatgatgatacttttcatgttgctgataaatagatatcagttgatgatactttccatgttgctgataaatagatatcaattgatgatgatactttccatgttgctgataaatagatatcaattgatgatgatactttccatgttgctgataaatagatatcaattgatgatactttccatgttgctgataaatagatatcaattgatgatgatactttccatgttgctgataaatagatatcaattgatgatgatactttccatgttgctgataaatagatatcaattgatgatgatactttccatgttgctgataaatagatatcaattgatgattatacttttcatgttgctgaagaagcgaaccctgaatgtgcctcagtctgtcaaactgacagtcagagggaggccctagtcagagggaggccctattctacactcagtaaccaggggactccttttcataagttcatgtaaactgcaaggggtacttaatagttttgttttcatttcttaccccaaaacctatctcccactaagccctctctataaaatgaaaaaattaatatctgtttcaacaggattgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactctagaggaatcaggtaatcctgtctatacctgtggaaaatgctgtgaaaacataggatgttgctacaaagaagttggcgtccaaattagagaaatgagtgcatcgctcctgttctcaggactctggatttctgcaaccttcttaaaatctttaatgaatatttgaaattatctcattgcacctgttatcaatcctctgataggaaccaagagagatatatgttatttctgagaaaagtgaggcttcgaaaagataaacaacctcattgtgattcaatgacttgacgttcagctcacagtctagaaaatggctaagtggcaaaactggtcttcagactcaagaaatgttcagtattatacaatagagtgcatttggtgtttgcagtcatggaaatggaatgtggggtcttattggaaataagctactccataccagacacgtattttaaaagaagaaatcatgattcttagaaaatcgggtgtcatgactatacatttaaaattctgtcaaaatcagtaaaacaaagtaaacagccaatgtgtatgcaaatgctttacatgaatagactatctagtctcaaatccaatagctgttccgggaggaaaaaatctcaatttgtttgccgtgagaatgtcaaactgatatttctgtaacagttagcatggccacagtgctccacagagagtgcaaagatcctgcatactgggtggccaatatgggtttaaaaaagaaggaatttttattgccctctccccaacaatactgtgcgtgcacacacacacagacacacacacacacacacacacacacacaatgcagcagcaacaacaggtgcagggaaaggttccagcaaccctttctctgctcctcagggaggatattctggagccttttcaaaggctcttccagagctgattgagaaggttttcttcgtcaataaacagaggtcaaggaatgcctctttgccatggagtctggtcaaagttaagtgtcccacttgtggacaggaacggaggtaggagctggatgcctgtcgaaaacaaactaaattccagaaaataatcttagtgttcaacaagaaagaaatgttttcaataaatttgtgttcatttacaagactggaaaactgtttaaagtagactacaagattggtgataattacttaaataagcatttatggaaaattgttgttttatatatttttataaattttatatttatataatatgaaaattcatattatatatttaaatattgtcatatatttaaaattcatatatattttaaaattaaatattaaaaattaaattatatatttacatttaaatattaaacctattaaaattggcattgaatttcttatatatgtcatgtatattatatatttaaaattatatattatatattatatatttataaaaatatattttttattttttataaattttatatttttataatttgaaaattcatgttatatatttacatattaaatatattaaaattggcattgaatttattatatatgtcaggaaaacaatgacaaagaaatacagcaacgttagcaatcagttttttttctcatacttttttttaacttttattgtgggtttgggggtgcgtgtgcagtttcgtgataaaggtaaactggtatcacgggggtttgttgtacacattatttagtcatccaggtactaagcctgatacccaaatagttattttttctgctcctctccctcctcccaacctccaccctcaaggaggccccagtgtgtgtgttgttcccttctttgtgtccatgagttctcatcatttagttcccacttataagtgaaaacacgcagcatttggttttctgttcctgcattagtttgctaagtaatggcttccagctccatccatgttcctgcaaaaatggacatgatctcattctttttaatgactgcaagcaatcagttttaagcatggtccagtattaaccacaatgaatatttcttccatattaataataaaaaatgtaaaataaaaaataatttccctattaaagataaaaaattggaaataggtattaaccttcctctcaagtctcaataaaaataacaataaaaataacaaaaagtgttctgttttgttttattttaagttgtaaacccataagagcagaaatatcaacagaggaaacaataacaacaaaataatgggggtggaaagcaaacaaatgagcaatcatggactaagagaccagttcaagcataaatcaaggctggcgatgggaaagcagagaagcaacatggtttacagcagaaaacccacagagcctcagaaacgagcagcaacagaaaaacaggctgttaaggaagcaggtcaacagctcccctaccgtggtcctcatttccacaccatcctgcatgccatggaacgatccgtcctccaccctggagaagcttagagcttattctgtggaatgggagaaacggagagtccctgtaatggagataccaagaaggagaggcgggtcatatactggaaacaagagaagcaaagttgatgtaaggaatattgagactacaactggatctttccttctgtggctcctaaaatgcaggtggcagagttgtaccttccatgcaggaaataagagggtttttctagggaattgagaggatctccagatagctgggcctatttaaatgagagtgaagcccaagctgatgtgaagcttgcacctagaatttccaatcaatcttctagggcctcactcttaaatataagcagacagctaaggatcaccatcctttgataggattaagaatgagcaaacactggaaacatactgaaatacagccggctgtctaaaacagaagatatagaatataatgaaagaccaaaatggatatgtgtagagattacacagggaagatagtggaattgacaactctggcagcaacgctgctaaggacaggatgaatatgaaaattgcttgaagttcaacaataaggagaaaggaggttgccaaaaagaccaggagaggcaagaacaaggcctgtcataaggttatagtgcatgaatggcctatcggttaagaattaattcagcagaacataattgaaaatacattttaaaggagcatgaataatatttgtattttctctataacaaggcaggttagttcaaatgcatcatgacgtcttcaggaacccacacttgtctctctttattgaacccacactcttctctttctattgatcccacactcctctctctattgaacccacactcttctctctgtctctcttttgttttgtttttgttttttgagacagagtcttgctctgtcatccaggctggagtgtagtggtgcaatcttggctcactgcaacctctgtctcccaggttcaagtgattctcctgcctcagcctcttcagtagctgggattacagccgcccgccaccacacccggctaagttttgtatttttaatagataccgtgtttaatttcaccatgttgaccaggctggtcttgaactcctgacctcaggtgatccgcctgccttggcctcccaaaatgctgagattacaggcatgagccactgtgaccagcctcttttctctctattaaacccacaatcttctctctctgttgaacccacactcttctgactctattaaacccacattcttctctctcaactgactcacactcttctctctctattgaacctacgctcttctgtctctattgaacccacactctcctctctctatggaacccacacttctctctctattgaatccatgctcttctctctctcctgaacccacacttttctctctctattgaacccacactcttctctctctattgcatcaggcttctcctgcgccttttcgtctcatgacttttcacctcattgttgaacagtgtctgctttaccttcaagttctgggtaggaagaagagcaaagagaaaaaggcaagaagtagttgccagtgtccatatctcttttaagagctctcctagaagccctacctagtgacttctgattatataatagcttcaaggagtatgtgggatttggtggttgttttaagctggactcattaccactgtgaaaaaaaatcacattgtatatttaagaaagaaagagcaaatgtatattacatagagaaccagcagcatacatcgctgattatttttgaaaattaaaatgttttagtaatgggcttgaaattcaattccagtcatcaataaattaaatgtatacaatgaagaagacttgtaatttaacaatcattctgggttgcttagtgggtgtgcaataatgacctttgaagaggggaacaggccgggcacggtggctcatgcctgtaatcccagaactttcggaggccaaggcaggcagaccatttgagatcaggagttcaataccagcttggctaacatggtgaaactccatgtctactaaaaatacaaaaaattagccgggcatggtagtgcacgactgtagttccagctaatcctgctgaggcaggataattgcttgaacccaggaggtggaggttgccgtgagctgcaattgcatcactgtgctccaggctgggcaacagagtgagtgagactccatctcaaatttttttttttaaaaaagaagggaacaaacaaaggaaatttctgggagagagaaaaatggaaaatgagtagctgtctcccttctttcaggtaactgctttcaggtcctccagaatttttattaatataaaacaacatttgcattatcctatcaatattgtagtttgtgacagtaagtcaaaatatacttttcactgggcaaaggacatgaacagacacttttcaaaagaagacatttatgtgtccaacaaacgtgaaaaaaagctcaacctcactggtcattagagaaatgcaaatcaaaactacaatgagataccatctcatgcgagtcaaagtgatgattattaaaaagtcacgaagtaacagatgctggcaaggctgtggagaaataggaacacttttacactgttggtgggagtgagtgtaaatttgttcaaccattgtggaagacagtgtggtgattcctcaaagacctggaaccagaaataccatttgacccagcaattccattacgggctgtatacccaaagtaatataaatcattctattataaagatacacgcatgcttatgttcattgcagcactattcacaatagcatatatatggaatcaacccaagtgcccatcagtgatagactggataaagaaaatgtggtacatatacaccatggaattctatgcaggcataaaaaggaacgagattatgtactttgcaggaagaacatgggtgaaactggaagccattatcctcagcaaactaacacaggaacagaaaaccaaagactgcattttcacacttataagtgggagctgaacaatgagaacatatggacacagggagtggagcaacacacactggggcctgttgggggcacaaggggagggagagcattaggataaatagcgaatgaatccggggcttaatacataggtgttgagttgataggtgcagcaaaccaccatggcacacgtttacctgtgtaacaaacctgcacatcctgcacatatatcccggaatttaaaataaaataaaataaaaatttaggtatatatatatatatatatatgtatacacacacacacacactttttacttggtgtatctaggaaatatacaaaagcttaacaataaactacccaagaatcaataaaaactaaaagttaaatataaaaaatgcctttccattgcataaaaatgtaatttcaccagcccaatgtatgtatcacttgaaaaaatgtcgttgcaaaatgcaatctcttttgtgctttatactgttgattttaaaatttaaagtcaggagagcaaagcacatataaattggttccttcttttatttctcaagaagtcactctttctttttcattaccatctgctctgactgctattacaatttttatcccaaaaggtgatgctgacagtgtaaaggtggtataattaacaaaattcttctctcatgacatttctcacagaaaactggaagcaagaaaatataattgcaccagcagatatgtttcaaaaccaagtaaagagcttatgaaaaataagaactcttaaatgcaagcactacagattgcctagatcaagacaatatccatgaattgaataggttttccagataataaattgatagaatgcagcacatatctccatttcttaagagagaaaaattttgtgtcaacatgtagatgcacagcatggtctgacattgggactgaattattctcagttaatcaatagcacgcatgtgaagtagccattcacagactcggctgctcactggcatgacctggacgacatttccctttacagattccttgacccactcccaagggtttggattcaatagggtttgggttgctctgggacctgtagttctttaaagccctcttgatgactgattaacaccaaggagaagattgacaaaaatctgtaatagcggaagcatttactacaagtaaaactccgtgtttaaacttgggggaaaggagtttatccttacgtagcttattatctagcacagtgattctcagctgagaataaatttgcctcctggggggcatttggcaatgtctggagactttttttttttttgagctggagtctggctctgtcgcccaggctggagtgcggtggcgcgatctcggctccctgcaagctccacctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgagcccggccgtctggagacattttaggttgtcactattgtggggtggagggtgggggtggggaggcggtcctactggcatctaatggtagagaccagggatgctgctgaacatcccacagtgcacagggccgtcctccaccaccaagaattacctggctcaaaaggtcaataccggcaagagaaaccctgatcccaatagggggaataagaaaatacattaaactatataatgaatggtgtagagatttaaaagttattgcaaagatatagatagatgctatcacaattcggagcagggtgagttagggccagcagagaaaggatcttaggctctggaatgaagtctatgcctcttcctacagccttactacttaagtgttcaacactagcggaacacttgcagtttcgagcatttgtgcatatggtaattaagctaaataaagttcctgttctccttgaaggtcacattctagttggaagaatcaggcagaacatccaaagtttaaaaaatggaaaaaacaagtgttggcaagcatgtggaggaagtaaatggaacacccatttctagtgagagtgacattggttcaaccactttaggaaactggctagcagtatctaccaaagctgatctacatgccctgtgattcaacacttctacccctaggtgtttgtttaacagcagtgcatgtgtatctgtgccaaaagacatgtacaagaatgctcatagtagtagcatgtgtaacagtccaaaactaggtacaattaaaatgtccattaggccgggcgtggtggctcacgcctgtaatcccaacactttgggaggccaagccggctggatcatgaggtcaggagatcgagaccagtcgggtcaacatagtgaaacaccatctctactaaaaatacaaaaaaattagctgagtgtggtggtgggtgcctgtaatcccagccactcaggaggctgaggcaggagaattgggtgaacccaggaggcagaggttgcagtgagccgagatcatgccgttgcactccagcctgggtggcagtgtgaaactctgtctcaaaaaaaaaaaaaaaaaaaactctattaataaaatgaatttttaaaaccaaggtgtatttttgtgtatacaatggaatactatatgcaattcagctgaatgtagtactgctacacaaaaatatgtagatttatctcacaaatgtaacattgagtgaaagatgtcagatatgaaaattatatatggtatgatcccattatataaaaattatatagagataaaattaatgtattatgaatcaaaacagttgttgtatcggaggaagattatgagtggggtctttctggaagtcatctgggtgctgtaatattcaatttcttgatctgagtagcagatctggtaatccatattgtctttgcttttttctgaataccacattttgataaaaatatttacttaatagagcaatgacaagtgctatgaagaaaagtaaagctgggtaagggacttagagagtggcaggtcagtgtcatagatattatttatagcagagatccacaagctttttctgtaaagggccagatagtaaatattctaggctttatgagcctacaatctgtttcacaatcattcaactctgcggttgtactgcaaaagcagaaatagacaataagtaaatgagtgaatgtgactatgttccagtgaaagtttatttgtggacactgaaaattgaatttcctaattttcatgtgttgcaaactactatttttgctttcgattttttccccagtcacttgaaattataaaaaatatccttagctcacaggccataaaaaaacaggcattgggtgaatttgacctgtgggccatagtctgcaacctctgaggtagaggctagtgggagaaagcctgcccaaggaggtaactttgcacagtcctaagcaaattgagatagcaagtaatgtattgatccagggaaggcgttttctctggggaggggagaggaagtaggaaggccatacggtggaagcttgctgagtgtgttcaaggaacagcttctgtggctagagaaaaatgagtaaatggcgacactggcagcaacaagccatggcccgagaggctcagagagagatgctctaaaacggagagctggtggcgatgaggaaggtgaaacagagggaagaaatcctggagcaaggatgcaagccagaagtctgaatctctcagagaagaccggagacagaactagcatgtggaatggggtggagaggaggaggaggcagggaggcagtcaagtgtctttccgtgcccaagctgcacaccacgcacaccaccaccaccgcacagacacacctcagagttatttagttcaagcattgtaagactggataaaggtgtatttctttctgtctctttttttctttactttctttcctcccttttttgtttttttcccagagaattcacatcaaacagcattatttataatgatgatgtccttctaggtaaactcagattttccaggtgaaagagaatggcaaccaacagtggcagcgattttttaaatgcgacatgttggccgggtgcggtggctcacgcctgtaatcccagcagtttgggaggccgaggcgggcggatcacctgaggtcgggagttcgagaccagcctgaccaacatggagaaaccccatctctactaaaaagacaaaattatctgggcgtggtggcgggcgcctgtaatcccagctacttgggaggccgaggcaggcgaatcacttgaacccgggaggcggaggttgcggtgagccgagatcgcgccactgcactcgagcctgggcaacaagagcgaaactccgtctcaaaaaaaaaaaaaaaagagacatgtcttcaggcttattgatgtatctgcccctggctggaagatttctcgaagctccaacataaagtaggacctaatgtctggcactgcggttgaaggaatgatttgcctactgggtgttttacttagcaacaactcagctttttatggaattccagttctccaatgtttgttctctgatgtattgttgcctcttttataacagtcattaaacactgaaaatgtctgatgcggcaaaacttaatggacacttactggttataatggaatgaagagtgaggtggaaaaaaaaagatgattacccaaagctttcataaaatttcttgttatcttttcacatcttttatacagacaatttatcttgggtaataggctatgcccttttgatctacagactagaaacacaagaattgtaatagcataatgttgtatcaggtatgccaaatacaatattttacctaatttcttgtattactttgcttcataggtcagggaaaagaaaacacatttaaagcaaccattaagataagaggacagatgcaaatttaaaatagttgaatttaggtaaacagaattaattaaacccttaatttcattagtatttacagagtgcctgccatgtgtcagacactgcctagattctaaatgactaaatgcataaatgagtctgtatagataaataaggcaggttaatataaataaatgaaattatatagtacctatctcataataactgcttaataaatgtcagcaacaaatattgttataaaactgctatgggatcttcacatttggtataattatgttaactacacgtatgaaaataagagtcattaatacgaaggcaactgtactaggggtagcatctcatggtgatgataagcatctgtgactagccaaaaagtgcttaatcaccccaaaaggcactctatgatgttggctaaataaatatcaacaacaaaaggcgtttctcaaattagttctagataagttgcatgtcacctgattctatgactatcggtcccattggtattctaatttcttttttcaaggatctttcctaaaaaatattattgatgccatcattttgacaaaaacttgttaaagtattattaaaactggcataattgaaatttatttttgtgattaagattgaaaattaaaaaggcacaaaatagtagcaaatataacttgttctcattatattgtttatgacaataaattccctggttaagcttacacatggttctctcttctaactctgttttcagttccttgtaaaagattattctttgaagctgacatttcttgtctcttatctataacaaaggttaataggtatattaaaatgcagagaaaacattcacattttctcctagaattaaagttttaaaaaagttcaagttttatataaatgtttggaaatgaattataggtagctacaggcaagacatgttgtcaaataaataccttcagataaatgttgaaaaagctatttctaatgtgaagttttaaatatgcttggaacataattggttagacactgagcagaatgaaaaatctaattatcagcaaagggaggagtctatccacaaagatgtaagaaatattttaaacttagaaatcaaaacgttctggagttttttagtcaaacttcctactgttgaacttaaatatgcagaaagtcattttatctatctaagtgagatgtggaccaagattaaaagagtattaaatactaaatatttcttccttttatcttttattaaagttaaatagaagtaagatgtgcttacggatgccaagagaaaatataatacaacagagattcctcgtgcagcaccatcagaatgtcatcacagtaggccatgtcagtctccacttaactttcacacattctgatggacaatatccataagtttgtaaaatgactgtttacaaagtatactctgttctacttttctcaatttaatgctgtgtttatctgcctgggtgttttctttttttcctctctctgtgtgtgtatacatgtgtgtgttgatagtgagcagaacatagccaggagcagcaaactgtttttggagaagaactcatttttaatttaaatgtgggctttatagacaagaataagaagctctgattgcagctaatttcagcaaattaaaaagagcctgcggggaaaactgactggtaatgatgaaatgcaatcaagtgagcaacagtatcgatcttcaaacacaaagctgagcagataataaaatacagtttgaaaaaaaccattcatttttattataggatatagcagatgctggtttaagtactagaataaaacaaaaagcctattgattattacagcttgtactgacaacattgtatatacatagctggcatcgtttgtagcagtttgctcgtgtcctcaggcagggtactaacccagaatgggcacccagccactttcttctgaacagaatctcatgcattaaatatttatgtttcagtgagtaaggaaaagagaaggaaatcaaacattcctcctgcgtgtgcgtggaacttttgtcgaactataaacacagcatgagcacaaacccttctactacgcccttcaatacttcccttgtctttgtttgattggcaaaatgtctcctagcaaggagtttctgaattaggccaaaacaaagacttgaaataaatgttatcttaactcttaaacagaaatattatttttaggattacttcttacagcagagcagaagcttgtttagtagagaaaaggatgctgtcagattctcagggtttagaagcaggactttagacagaaggtagaactatttagacagaggaagtataaagggttctaaaatgaatgggaatgaggcagggtgatttcaagaaaaaaatactgaacttatccctagagaatataagcattttcattccttccttcctttcattccttccttcctttactcattcattcaaaaaattgtatagattcccagtagaggcataaccaggctggaaccttcaaagtcagaagtctggcagggcctgggtcactgttggtgagagaccactcttctgtcttcttgacatgttcctggccttgtttccacactgtttcctgttacaacctttcatcaaaatcttttttttattatttttttattaccataggttattgggaaacaggtggtgcttggctacatgagtaagttctttagtggtgatttgtgagattctggtgcacccatcacccaagcagtatatacactgcacaaaatttgttgtctttaatcccccatccccttcccacactttccctctgaatccccaaagtccattgtgtcattcttatgccttttcatcctcatagtttagctcccacttatgagtgagaatatatgatgtttggttttccattcctgaattactattacttagaatagtagtctctaatcttattcaggtctctgtgaatgccattaattcattcctttttatggctgaataatattccattgcatatatatactacagtttacttttccactcgttgattgatgggcatttcggttggttccacgtttttgcacttgcaaattgtgctgctataaatgtgcatgtccaagtatctttttcatataatgacttcgtttcctctgggtagacagcaactagtgaaattattggatcaaatggtagttctacttttagttctttaaggaatctacacattgtttttcatagtggttgtactagtttacattcccaccagcagtgtagaagtgttccctgttcaccacatccatgccaacatctgtcatttttttgattttttgattatggccattcttgcaggagtaaggtggtatcacattgtggttttgatttgcattgccctgatcattagtacattttttcatgtgtttgttggccatttgtagatcttcttttgagaattgtctgttcatgtccttggcccactttttgatgggactgttttttcttgctaatttgtttgagttcattgtagattctggatattagtcctttgtcagatgtatagattgtgaagattttctcccattctttgggttgtctgtttattctgctgactgttctttttgctgtgcaaaagctctttagttcaattaagtcccagctatttataattatataattattataattgtttttattacatttgcttttaagttcttggtcttgaaatccttgcctaagccagtgtctagagaggtttctccaatgttatcttctagaatttttatagtttcagggcatagatttaagtccttgatccatgttcagttgatttttgtataaggtgagagatgaggatccagtttcattctcctacctgtggctagccaattatcccagcaccattttgttgaatagtgtgtcctttccccattttatgtttttgtttgctttgtcaaagatcagttggctgtaaatatttgggtttatttctgggttctctattctgttccattggtctatgtgcctattgttataccagtaccatgctgtttcagtgactatggccttatagtatagtttgaaatcaggtagtgtgatgcctccaggtttgttctttttgcttagtcttgctttgactatgtgggctctttttttggttccatatgaattttaggtttttttttctagttctgtgaagaatgatgttggtattttgatgggaattgcgttgaatttgtagattgcttttagcagtatggttattttcacaatattgattctacccatccatgagcatgggatgtgtttccatttgttggtgtcatctatgatttctttcagcagtgttttgtagttttccttgtagaggtccatcacctccttggttaggtatattcctaagtattttattgttttttgcagctattgtaaaaagggttgagttcttgatttgattctctgcttgttcgttgttggtgtatagaaaagctactgatttgcatacattaaccttgtatccagaaacttcgctaaattattttatcagttctaggagctttctggagaagtctttagggttttctaggtaaacaatcatatcatcagcagacagcgacagtttgacctcctcgttactaatttggatgccctttatttctttctcttatctgattgttctggctaggacttctagtactgtgttgaagaggagtggtgaggtgggcatccctgcttgttccagttctcagagggaatgctttcaacttttccccattcagtattctactgactgtgggtttgtcacagatggcttctttacattgaggtatgtcccttgtatgccaattttgctgacagttttaatcataaagggatgccgggttttgtcaaatgctttttctgcatctatggagataatcatgtgatttttgtctttaattctgtttatgtggtgtatcacatttgttgacttgcatgtgttaaaccacccctgcatcctagtatgaaacacacttgatcatcgtgggttatctttttgatatgttgttggattcggttagctagtcttttgttaaggaattttacatatgtgttcctcaaggatattggtcggtagttttctttttttggttatgtcctttcctggttttggtattagggtgatactgacttcacagaatgatttagggaggactccctctttctctatcttgtggaatagagtcaataggattggcaccaattcttctttgaatgtctggtagaattctgctgtgaatctgtcttgtcctggacttctttttgttggtaaattttttttttttttgagacacagtctcgctctgtcgcgcaggctgttgtacagtggcatgatcttggctcactgcaacctccacctcccaggttcaagagattctcctgcctcagcctcccgagtagctgggactacaggcatgtgccaccacacccagctaattttttgtatttttagtagatacagggtttcaccgtgttagccaggatggtcttgatatcctgacctcatgattcacccaacttggccttccaaagtgctgagattataggcatgagccaccatgcccggcttggtaatttttttattgccatttcaatcttgctgctgcttattggtctgttcaaggtatctaattcttcttgatttaagctaggcagattgtatcttttcaggaatttatctgtctcctctaggttttctggtttatgtgcctaaaggtgcttatagtagccttgaatgatcttttgtatttcagtggtgtcagttgtaatctctcctgtttcatttcttattgagcttatttggattttctctcttcttttcttggttaatcttgctaatggtctatcaattttatttatcttttcaaagaaacagctttttgtttcattgatcttttgcatttgtttgttcatttgtttcaacttcattaagttctgctctgatcttggttatttcctttcttctgctgggtttgagtttggtttgttcttgtttctctagctgcttgaggtgtgaccttagaatgtctgtttgtgctctttcagactttttgatgtaggtgtttagggctataaactttcctcttagtattgcctttgctatagcccagaggtttgggtaggttgtgtcgttattcattcagtttgaagaattttttaatttccatctcgatttcatttttgacccaatgctcactcagaagcaggttatttaatttccatgtatttgcatagtttcgaaggttccttttggagttaatttccagttttattccactgtagtctgagagagtgcttgatataatttcaattttcttaattttattgaggctcattttgtggcctatcatatggtctaccttggagaaagttctatgtgctgatgaagagaatgcatattctgtggttgttgagtagaatgttctgtaaatatctgtcaatatccattttttccagggtatagtttaaaaccattgtttcagtgttgactttctgttttttttttttttaagagggagtcttgctctgccgccctggctggagtgcagtggtgtgatctcggctcacagcaacctccacctcccagattcaagtgattcttctgcctcagcctcccaagtagctgggatcacaggaatgcaccaccaagctaatttttgcatttttaatagagacagggtttaaccatgttggccaggctggtcttcaactcctggcctcaggtgatcctcccaccttggcctcccaaaatgctgggattacaggcatgagccactgtgcctgacctgactttctatcttgatgacctgtctagtgctgtcagtggagtattgaagtcccccactattattgtgttgctgtctttatcattccttaggtctattagtaattgttttataaatttaagagcaccagtgttaggtgcatatatatttaggattatgatattttcctgttggacaaggccttttagcattatataatgtccctctttgtcttttttaactgctgttgctttaaagtttgttttgtctgatataagaatagctactcctgcttacttttggtttccatttgcatggaatatctttttccacccatttaccttaagttgatgtgtctttatctgttaagtgagtctcttgaaaggcagcagatagttggttggtgaattcttatcaattctgcaattctgcctcttttaagtggagcatttacgctatttacattaaatgctagtagtgagatgtgcggtaccattccattcattgtgctatttgttgtctgtataccttggttgttttttttttaattgtatttttgtttgataggtcccgtgagatttatgctttaaagaggttctgttttgatgtgtttccaggatttgtttcaagatttagagttccttttagcagttctcgtagtgctggcttggtagtggtgaattctctcagcatttgtttgtctgaaaaagattttatctttccttcatttatgaagtttagtttcactggatacaaaattcttggctgataattgtttttgcttaaggaggctgaagatagggccacaatcccttctagcttgtagggtttctgctgagaaatctgctgttaatctaataggttttcctttataggttacctggtgcttctgtctcacagctcttaagattctttccttcatcttaatttagataatctgatgacaacgtgcataggtgatgatctttttgtgtttaatttcccaggtgttctttgtgcttcttgtgtttggatgtctaggtgtctagcaaggatgaggaagttttccttgattattcccccaaatatgttttccaaacttttagatttctcttcttcctcaggaaggccaattattcttaggtttggtcatttaacataatcctagacttcttggaggctttgttcatattttcttcttttttctttgcctttgcaggattgggctaatttgaaagccttgtcttcaagctctgaagttctttcttctgcttgttcgagtctattgctgagattttccagagcgttttgcatttctataagtgtgtccattgtttcctgaagtttcgattcttttttatttatgctatctatttccttgaacatttctgccctcatttcttgtgtcatttctttgacttccttaaattgggccttgcctttctctggtgcctccctgattagcttaataactaatcttctgaattctttttcaggtaaatcagggatttctccttggtttgaatcgaagtgagctagtgtgattttggggggtgttaaagaaccttgttttgtcatattaccagggttggttttctggttccttctcatttgggtaggctctgtcaagagggaaggtctagagctgaaggctgttgttcagagtcttttgtcccacggggtgttcccttgatgtagtactctcccccttttcctagggatgtggctttctgggagccaagctgtagtgattgttatctcccttctgggtctagccacccagcaagtctacccggctctgggttgtctgcagagtcctgtgatgtgaaccatctgtaagtctcccagccgtgcataccagcatctgctctggtggaggtggcaggagggtgaaatggactctgtgagggtccttatctttggttgtttaatgcacgatttttgtgctgtttgggctcctgccaggaggtggcgttttcaagagcacatcagctgtggaagtatagggaggaacaggtggtggtcagggccctggaactcccaagaggatatgccctttgtcttcagctacccgggtgggtagggagggccattaggtggggacacggctaggcatgtctgagctcagactctctgtgggtgcgtcttgctgtggctgctgtaggggatgggggtgagattcccaggttaatggagtgatgttactaggaggattatggctgcctctgctgtgtcatgcagcttatcagagaagtgggggaaagccacagtcacaggcctcatccagctcccatgcaacccaaagggccaatctcactcccaccatgcccccgcaacagcaccaaatctgtttccaggcagtgggtgacagggctgagaactcgccccaggctccccacctcccagctgtgaaagcaagtagggctttcatgcttcccctactgtggagtctgactcgcgccctcccccgggttctggccaggagacttctccatcagctcaaattgttacaaagttcagctggaggtttccttctccctgtggccttctcccagtgcctctggcagccctcctcaaggcccccgtgaggcagggcagaaatggcttgctacgggacccatcgagcgagcccatagggctcttcctgctgcttcctctacccctgtatttcacttggctctctaaattgactcagctccaggtaaggtcagaatcttcttccgtgatctagaccttcagggttcccagtgaaggtgtgtatttgggggcagacaatcctgctttcccacttccgcagtttgggcactcacagtatttgaggtatctcccggctcctgcaggagcaatccacttccctcagagggtctatgggttctgtcggctttcctgatttgttcctgcagtcgctctggagcaagtgttcacagtgcaaggctccacatgctgctctgtctgtctgagtggaagctgcaatctagtcctgcctcccgtctgccaagatcctcccactttcatcaaagtcttaaaacatgccgcgtgcctgtagtcacaactactcgggaggctgaggcaggagaatcgcttgaacccgggaggcggagcttgcagtgagccaagatcacgccactgcactccagcctgggtgacagagtgagactccgtctcaaaaaaaaaaaaaaaaaaagtcttaaaacaaacatcacatcagcaaaataccgtgcatttgtagagtaggtgagccttttggaaaatgtgttcccccatctaattacattcccagcactagctgtcacaatgccaccattaaaatggggaaagacagagaatttaaaaaacaaaaacaaaccaaaaaaaacccagatttttaaaatgtgatcagttctgacactgcaactgctataaaaccaataaaaaatacaatagaaagagagcgggtttggcatgaagggctgtcttagttgtcacagatgccctctcagatgatgagcagaggtgttgccctgtccagatctgagcatacagctttctacataaaggaaacagtgggtgcaaggccctgaggctggaacgagcttggcatatttgaggaaccacaagaagactggggtagttggagaatagcaagctatgacagagtggaaggactgtgacaggagatgaggttgaagagagacaagaactagaaagggagaactcacaagtcatagcctggagtttagagttgatgctaagggccatggggagtcactgaaagtcagggatgtgtaagtaattaattgggaattttttaagtgaatatattgtccgcaaaaagtttgtgaagcagcttatatccactattcactttttacttaaataaatttacgcctatttttttttcttttttgagatggagtctcactcttgtctccccagctggagtgcaatggtgcgatctcggctcactgcaacctccgcctcccaggttcaagtgattctcctgtctcagcctctccagtagctgggattacaggtatgcaccaccacgcctggctaatttttgtactttcagtagagacggggtttcaccacattggccaggctggtctcaagcttctgacctcaggtgatccacccgccttggcctcccaaagggctgggattacaggtgtgagccaccgcacccggcctaattcacgcctattaatgtatttttcccaaatgcaaatagctctggttttcattttcttataaaatacctgagattctttcactgcgaatccttccaagtacctatgtttttataataccctatgtttctttaccacatcaattatagttacggttataaacaaattaataattggaataattatctatttttgtcttttcttacagactgtaagctcgtgtgtgcagattgagtgcttgaacactcagcacataactgagatgccagaaaatactttcattaaataattactataatcatataagctttattcacttactataatatgaatatttctcatatcaccaaacttttgcgttctacacttttgtatagttgcaatatcctgctgttgactaatgaagttcttccaagtttcaagaatgaatttttattctacataaaaatgttcctatttgcttaaatagttaacttacagggatttcttaggtccctgggctgctgtcttatctcagtgtaaataatagtgaaatggagtcttttaaagtgtctcctaatatgttgtgagttgatttatgtccctgaaaaaaggtatgttgaagtcctaacccctggcaccttagaatgtgaccttatttggaaatagggtcatcgcagatgtagttagttaagacaagctcatactggtgtgtaggggtgggcccttaatccaatatagtaacttgaatccttatttagaaagagaaggcatgtgaagagacagacacatacacagagagactccctgcaaggactgcagttatgctgcctccagccaagccactaccagaggccaggagagaggcttggaagagatcctgccccaggatcctcagagggaacatggccctgctgactccttgatcttggacttctggcacctccataactgtgagataataaattgctgttgctctaagccacctactttgtgatactttgtgacaatggtcctaggaaactaatccatcgtcagagacagctaaactacacttgctcatctgggcagaagttgtgcagatccatcttaatcataccccagagccattgctgtgatgcccacaaagctggatctcaagtcacagggacaagagataaaggggtaatttacaaaattaaacacagcctgcccagttacagttcaattttaggaaatcatattatataatactggaacatacttatacttaaaaaaaaaaggtgttgttcaaggtcaggagttcgagaccagcctggccaacatgatgaaacccccatctctactaaaaatacaaaaattatccgggcggggtgacaggtgcctgtagtcccagctactccggaggctgaggcagggaatcgcttgaactcaggaggcagaggttgcagtgagccaagatcgcaccactgcactccagcctgggtgacagagtgagactctgtctcaagacaaaaaaaaaaaggtgttgtctatctgaaattcaaatataactgggcatcctatgtttttatttgctaaatctgacaaccctaggaaggcgaccagcaggaggtaaacatgcccttgggacgtgctagggcaggcgatgtcttcacttctgagcactcaccctggcggtccacacttaacaggagttggcccagagagacggaagcaatccatgcaaatcccctctcaggctcagtgagatgcatttggaaaaggtgaaaaagatgtgcctcagagaatcagagaagcaaaaagagtgactgctagaagactgttgtaaaatgagtgggtaaagccctgttggaaatggaagaagataagaaaataaaaacaaatcctcctattgccattacttgtgctttgtgacattgtttattaaccaagtagaaatattaccttaaaataccagagattataactaagacactggaagagggatgtaagaaagaatgtttagtttctgtttactactagaagaggctcaagaaaatgttgaagtgtaacacagaaatgaaaatgtattttaaggctgagtgcggtggctcacgcctgtaatcctaccactgtgggaggccgagtagggaaggctgagtgtggtggctcacgcctgtaatcctaccactgtgggaggccgagtagggaaggctgagtgtggtggctcacgcctgtaatcccagcactttgggaggccgagtagggcagatcacctgagtcaggagtttgagaccagcctgaccaacatggcaaaaccctgtctctactaaaaatacaaaaattatctgggcctggtggcgtgcgcctgtaatcccagctatgccagaggctgaggcatgagagtcacttgaactcgggaggcggagcttgcagtgagccgagatcgtgccattgcactccagcctgggtgacagagcgagactctgtctcaaaaaaagtaaaaataaaaataaatatttgaagagggctaaacaaattacagcaaaatttcctggcattaatataagagcagatgaagatgtccactctcatttgatgtttgtgatagagaggatgatggaagggcccaaagttagataaattcaagaagctcgcaaaagaacgtgcacttctgggtgttcagacaaatggatctggcagacacaaagcccagaggctgcaggtgaactagcttgaggataatgaatagaaaatgcaaactacccccaaaaagagtgacacaaggaaaatgacgttctgaagtaagaaaggggccaaaaacaggaaagacggaagcaggtaagtttgataatgatgctgaaaaggcctaaacaggattttgacgcaagagatagaattactttcccaaattgcagggttcagcatccagaattcagttgtcaaggttgaattcaaatttgggttaggattatcccaaacaaaaatgataaggaacactcctacattattgtgggaataaatccaagggaatttacttaggctggggaaagtatgtttaaaactcagtagctcccatttcaatggcaaagacacagtaattttcctaaaacaagaggcctgctgtgcattttctagtaagaacctacaaaactgaagctggtgaataaatcatttaaatcaaggaaaggagatacgctgcaacgcttaaagcatcctagaggagtgtgactgtcaaaaataccttctgattatgtgacgtgtttaagactggagctctcacgaaggatccatttgaccactgtgcaatctaagcgtgaggagagtgtgaaggtcagtgatctttctgctaatactgaacatgtctcagactacgccaccggagacagggagttgcatcaggaaacaccaaaggaagagcaaaaggagaagctgaaaacacaagaaaaccaaatgcatttataaaaaaaaaaagaagaagaaacatcaagctgccttcttcaggtctaggagactgtgcattgaatttgcacagaagtttctagcgtgatggatgaaacctggttgccatccaaccaggaaaaagaaaaagcaacattaaatgtcgccagggccttttccctgcagtaataacacaactggcaaggatatcctgaatatagcacataaatatgttctttctgcttcttgctagcaggagatacaaacagcctcttccacgttttcatgttcatgtttattaaagtcacagacataaaatgttaaggttctaaagaatgaaaatgtcagtgttggtataaaagtatgaacaccttgcacaggttattttaggaggaaaatttgatcatggcaccatatattttcatatatattttaggattatccaccaccataaatgacatttctcagacaactgtaaatagatcactgcacattgcagtcatttgttcactgagcatgcacagccaggtgctgtggagggaacaaacatgaaaacaaacacacacaaatgtggggcccgcctgccttcaagctccaagagccagactctctaatgagccattaagcatgatcagaaacacaaaacggaaacaaaaccacaccgtaatttaagataaaaagtgattaagtgtcattagagaagcagaggtaaactgtaaccagagttctgagaagagtgtccagggacaagctgagaggccgtcagcgttgcacgaagccttgctgcctgcttcaaggacatctggtctgccggcatctgagggaagaggctgaacaaagtatttccttagcacaaacagaaaaataaatactttgagttatgtaggatattgacattggtgttcatgtacttagtaggtctcatactgttttgctgtaataaccccagtggtgaagaaaagcaaatgtatacccctagtcaatgtggggtgacggcccaagcatcctgtctcaaacaaaacatgtttttgctgtctcttttgttgttgttgtttttgagacacagtaccccaggctggagtacagtggtgttatcatagctcactgcacctcaaattcctggattcaagcaagcatcctgcctcagtctctcaagtagctaggactacaggcatgcactaccatgtctggctaattttttcattttttagtagagatgggggtcttgctatgttgctcaggctggtcttgaactcctggcctcaagtgatccttccacctcagtctcccaaagtgctgggtttacaagtgtgagccaccatgctgagtgaatgtttcacatttaatctcaaaaattcatgtaaattgttcattctactgcatatcatatcctagttcagttaaaatggaatcgttagttatcaggaaaataaaaataaaaaccataataagataccactttataaccactagtatagctataataaaaaagacagataataacaagtgttggcaaggatgtggggaggttggactcttctcatacattgcaggtgggaatgtaaaattctgcagctgctttggaaaacagtctagcaattccccaaatggtgaaatatagacttaccatatgacccagaaattccactcctaggtatctacccaagaaaaatgaaaacccatgtccacacaaaaacttgtatacaaatgctcatagcaacattattataatagccaaaagcggaaacaacccaaatatctatcaactgactaatggataaacaaaatgtgatgtattcacatgatggaatatgatttggctatgaaaacgaatgcttcaacctggatgaaccttggaaacggtaagtgaaataagtcagtcacaaaggactgtatattttatgattccattcacgtgaaatgtccggaataggtaaatctatagacagatagtagattagtggttgcctagagccagaaagaacagggaaatacagaggtgatgaacaaagagaataggtttctttttggggtgatgaaaatgctctaaaattgaatgtggtggtgattgcacggctctgaatagactaaaaatcattgaattgtacactttatatgggtaaattgtatgatgtgtgaattctatttcaatacagttgttgcaaaaaaagaaatttatatttttaaaattttgtttttagagacagggtctccaatctgtcacccagattggagtgcagtggcgatcatgacactgcagcctggaactcctggccccaagcgatcctccctccccgctcagcctctcaaagtgtgattacaggcattagccaccttgcctggcctaaaatggaatttttaaatcctatgcttaaaaaaaaaaaaaactgcaatagcacatgctaagcttgacaaaggcgactaatagaaaaatttctgaaggaaaacaggcaagtctgccatatcccctcccccgaggttattaaaagttagcagtttggaacatacttgccagcctttttctatgcttttacctactaaatgtgcacttagacgtttatgtacgtgcatttatgcaaccttgtttctaagaaaattaaataatttgctgccagcatactcataacctccccattctttctgcgaagtggctacttcctataccactggaacaaaagtcgtgtgcgtaacccaacatgagaagcgcacgatttagttcagtgttctccgtcctccacggttcgcagttgtcacctccaaggcctctgaggatgaaggactgggacaggcagaggcagagcccctgccgggaagcagagaacattaaggtggcagcctcagccctgcctctccacttgcccaggccagcgttctcagcgcacctgccgcgccacaccccccgtgccacacccccctgtgccacacaacccccgtgccacacaacccccgtgccacacggccaacacacgccacacgcccccgcgccacacgcccccgcgccacacggcccccacgcgcctgctgctgcttcctgccctggcacctgtcctccgctctcttctctctgtgccgccctcttccattgagtgctgccgcttacccagagccgaaacgtcatctgcccctgggatttccgtggctgttctgagtcccacacattcatctccctccagtcctggaggcctctaggactgcggtagggaggggaaagccgccgcgagtgggccagcttgtcagtcaccaaaccccctgcattaggactaattcttacctcatatgacttgtttccttttgcttttagagacggagtctcgctctgtcgtccacactgcagtgcagtggtgtcatcgcagctcactgtagccttgaacttctgggctcaagcgatcctcttgcctccgcctccccactagctaggactacaggcaggcaccaccacgcctggccaagattttattttattttttgtagggatggtctcactatgctgcccaggctgtgtggtccaaactcctggccttaagtgatcctcccacctcggcctttcaaggtgctggggttccaggcatgagccactgcagcttgcctgttttgaggattactcgcatacacaaagaggcatgcagacttcagcaaggtgatttttattttcaagatcacagagctaatcaatatcggaatctggattgtgacacagatcccttcctccatgtttaatacactttccactctacttctgatatgctttaaacagtattccaaaatgattgttaaagaggacattttgaacatatgtcagtaaaataattgtattacaggaagcaaataaggaggcatgattgtggcattctcagccatttttaaaaaaatagttcatgtttcctcttagcacttccattgtgtgagcagagtctgtaataacgtgctcagtctacaacatcacttcatatttttcatttcatatgagttcattttttgcaggtataagaaactatcttcaggtttcagataaaattgcaactgaacttttaaaacctaagtttttgttgagtccaggccataaaaatctatcagaaggacctaagccatttaatcatccagattatcagcacttctacaaaaaggttttaaatggcaagaagataaaatgttaagtgaggatagtaattatttgcctttatctcttgtgccaggtttcaaacctcaccatatgggtgtttgtgcaagattaaatagctattcaagtgtgtaatgaagtatagatactaaattgaaccaaaagatatagcatggaataggtcagagaagatccactctgcagaaatggactatgaaagagttgattgatagatattcatgattccaatccgacgtgtactttgagggccttttaacaaaatagagaaaattcttctttttaaattatttcctataggaaacaaaatactacgggggaagtagcaaggaaatttggggtgaaaaaatagactgccatctgcaaatatcctccagaagtagactgaatgaataacttgatttgctcaggatggcccagtgtaagcattaataattaatgtcaatctccttttactcttagaaatgtcctagtttcataaattacggtcactctatctggaatgatttttgagagctatcgtcagagtcaaaaaaacttaagcatgaaacttgcctccacaataagtcactaaatgtgctttcaagaagacacttgagaaggaaaggggttataaaaggtttagaaaatctgagctatactctaggaatgtgatagtcaacgtgtgtgtgcatatgcataacagggagagggagattgggaggccgaggccggtggatcgtttgaggtcaggagtttgagaccagcctggccaacatggtgaaaccccgtctcaactaaaaatacaaaaaattagctgagcatgatggcacgcgcctgtaatcccagctactcgggaggctgaggcaggagaatcgcttgagcctgggaggcagaggttgtcacgagctgagatcgcaccgctcaactccagcctggatgacagagtgagactctgtctcaagaaaaaaaaaaaagagagagagagggagagagagatggagagataagcaacagtttaggtcatctgatgcaggatctgttcacccttcactcagaactcaaacaatggggaatggtaaatgtatcaagattcatgtaaaactggaataaaatcaatatattttagaagcaagatgtgaatttttcaggaaacacagaaaagcaaataggatgaatgctttcgtttgtaaaaatttccaagatatactattagatagcaaaagcatacagcaaaacataaagtgtgattctattttttgaagacatattaaatatttgacatgctttagaaaatgtctgagggactacataccaaacagttaataatagtgttgtaaatgggtaattgtttctatctgggttaaatgtgattacatgcttactgcttcccctctgtgtgtgtgtgtgtgtgtgtgtgtgtatgtgtgggtatgtatgtgtgtgtgtatgtgtgtgtgtgtgtgtgtgtaagtgtgtctctccgcctcagtcacaacagaggtttcttcttcagtgtgaaccctgacatgagaaaacacgcagagcccagcagagattcagctgcctagcagccgcgtgcagtgtgaagaagaaatcaacagagggtttcggttacagcacaaagtgactaatacaagcggtcataggtgaagggcaagattcctaaaaagcgtttttccgcatttatttctatgatgaaagactttcttatagccagtactaatgatgaagctgtgcaacaacaatgaaaaaaattcaagcttctcatttattcccttcttaccccctcctcattcacagccacaaaggaagtactaccaccaccaaaccaccaaaaggcaaagggtagacaatgattttctgaggtttctttcacctctaagttatatatatatttttttgagacggagtctcgctgtcgtccaggctggagtgcaggggcgcgatctcggctcactgcaagctccgcctcccaggttcacgccattctcctgcctcagcctcccgagtagctgggactacaggcacgcgccaccacgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggcctctaagttataatttttattgtaaaaaatagatgcatatttagatatgtgtgactttgggggttgtgttttaaatagcagctgattttgttttagtctatattagcatctcaggttcttttttaaaatctaagcaaatcaaaatgacttttcagaccaaatgtgtaagttttaatccatcctaatttcatgatgaactaaaaagcacaactgggtcatagtggaatcaggtcattcaatataaattactacataactaattcagttgcaactcaattgaaaaggtaaatagtcatgacaaccaagctaaacaattcttctaaggtagtttatggaaacataggcaaggcttcttttcatgaattttaaaacatccttcctttgtagagatggtgaaatatgtgccctccttttcccctagtttctcctcagataacctcattcaacctcatggttttaaataccttctctctgtggctgctgatgaccaaatttttaatctagccctgaaacactcttcaaacattcagacttcttgaaatcaaaacgctttcttgaaatatctcataggaaccttgaatcaatctcaaccaggaggaactgcctgactttctccagcatttcctacttcaggaaatgccattgttaaagacatgttcgctgaataacctcaagggttgagaattcaagtgaaatactaaaattcagtctgctgccattttaagtagccataaaaaattaggtcccctatataaagaaatacatcaagttcaaaaatctttaaaattaaatggaaaagatattgacatgtcttaggatcccatcaaggtttgagttttataacctgtattctggataacctcgtttcactgagatggtaaatctttttcagtaggctatctttccacatgaggaagattaagaactacgtgaaaatgtttaagagaatcaaagccaagatataatattttgtattaaaaagaatccctctctacttggtactttatgttataatgtttaagatcatttgaggaattacaatgacagccttttaactttaatttatgtacaaattaataatctgtttagattaatggcttctgttattctctgtatcacagtaacacaaatgcacatctccacatacaattttttctcaaagttttatacaatcaactgcctatttgacatctccactggaatgtctaaacagaaaccttacgtgttaggtgtccaaaacccagtcctgactttccccctaaacctgcagccttccccatttcagttgatgacaagttcattcttctctattcctgagaccaaactccctggaagtcatattagactctgcttttctcactccccacatccaatccattatggaatcctagttacctgaagtttgcacatatcccacatctgacctcattcacttccaccaaagtgacttctgcctcctttttgccctaaagactgttctaaacatagcagtcagagtgatccaggtaagacctaaatcagatgctgtctctcagcatcactcagaataaaagacaaagtccacacaaggcctgaggagctttccctccccattaccagtttaacttaatctgccgctgccctgcccctcaatctcctcggacaaagttggcacgctctctgcactggctttgcactggctcttctcactgtccaggacttcctttccccagatcaacttggcaaattccttcacctgcttcacattgtcacttaaatgcaccgtcccaataagactcaacctgtccatcctgtttaaaattacaactcattttaaattcccaattgctctgatcatgttctattgttttccttcttccatagcaggtatgtgcgtatcacctaattatcacatcatttactgatttgttacacttatcatttttatttattggaaacaaatgctttctatttgactgtattaataagttccgggaggaaaggggtatttgtggatgcttcccaagtgcttagatcagtgcctgacacatagtggccactcaatacatatctattattgctgacttgcgactttcagtaaacatcacactaagttaacaacaatatcatatattaacacatgaggaatattccaaaaaatacagattttccgcctctcagaccagattgctgcttacttggtgttttgtttgtttgttttgtgttttttgtttgtttgtttgtttgtttgagacggagtttcgcccttgttgtccaggctggagtgcagtggcctgatcttggctcactgtaatctctgactcctgggttcaagcaattctcctgcctcagcctcccgaatagctgggattacaagcgcacaccaccacacccagttaattttttgtatttttagtagagacgggatttcactatgttggccaggcccagttaattttttgtatttttagtagagacgcggtttcaccgtgttggccaggctggtctccaactcctgacctcagtaatccacccgcctcggcctcccggagtgctgggattccaggagtgagccaccacgcccggccctccttgggatttttaaggtagtgcattacggtccatctcactcacctaccagcttcttcaaaacatcttcaagaaacaaattcccattttggttgaagattgcactttgacacacgcatttaagtataacagtatattctatagtaatttgagaagtcctgttggggttaaaaagcaaattctttatgtctccaatgtactttctccactatgatcagtggcttctcaagagtaactccttgaataagtcacacatttctgccagtttaataccagtcttggcttctctctgcctcaggatgcagccaatactcctgaatgtggctaagaaagtccttcataagcacgtttctgccattcctttagaatcctcttttgacacaattccctctcagcagaaacataaactctacctgaacctaccattttctgcctttaggttttaaatatgctactctctttgcctacatcacctcattcgctaatgcctactcaaccacttgatcacattccaagcttttagttttcttccttcccaaagacttccttaatccttcaagaactggataaagggttccctgagttctcataacttctcataatgacccgcatctttgcactgttccctccagtgagctaacacagtgttgggatgagggaggcgctaaagagacacttgccgaatgaacgagtgaattttctgaagaagcagccagtgaatcggagccggcaatttctctctcaacaatgctctctgctgtgccattcaacgaggccacaatgccattgtgtgacaatggtatgatgacactgcttgggccataacagaataattctccagataacatatgcacttgttatgcagctagatgcttttatgattgcttttggaggtgatgtggcaaataaattttttacttttataggactgctgacatctcacagaaatttttgacaaatattcaactcagatatgattttggttctactttatggatttcctgatcctttatatactacattttatttctttatgagcttactctgtttcatttttagccctcaaattcaatgaccaagataatgtaacagcatgagcacagaatatgacctctgctcagaagaattccatttccatgtaatatatgtacagggcttggtgaaggatgaagctgctcttcagcctccctctagttatcaactaacacagcaatttctgatgctttattatttttttcctgaatggctttttctgtagtacccattcatgccttctgatctaattagtataattagccttggacacataagaaacaaagcaacaaataaaaaagcccataaaattccatttcaataccctgcctttcatagactttatggaactaagtattcagctgtcttcatagctcataacctttaatcctaacatcaatctcagtgttctattcaattacaactgctgtctattgagaagtagcaaaggttttgaagagtttgtgggaacgtggaagttgccccattcattttcattagtaaactcaggagacacaaatttcactaaaattgctgacactgttcctgctgtgtctggatgatttattattagacttcatatttcttccaaaatatggtttaaggaactcaagaaaatcatgcgattgttttacctgaaatatgatgtaattttatcacctgtgcactaaagttgctgactgcaacttggacagaatagcacaaaaggctttgcatggctggagggaaaggaaataaagagtgagacccataaccagcacagagtacagcacggttagttcctatgacagagacaacagaggagaaggtgtatgttgtatttgtttttctgagacaggatcttgtatgttgcccaggctggaatgcattggcatgatcacagctcactgaagcttcaacctcctgaactcaagtgatcctcccgcctcagcctcccaagtagctgggactataggcatgcaccaccatgcctggctaatatttttttaaattttatttgttgtacagatgtggtctcacgatgttgcccaggctggtctcgaactcctggcctcaagcagttctcccacttcggcctcccgaagtgctaggattacaagagtgagctgccacacccggccaaagtgcacattttaaaaaggcaacttgctgcacctagaaaaatagaaaacaattgttatttaaaaaccaagtcatgaccttttgaggcaatatcccagcgctaaacggcaaatgttatcacttgtaaaagcaattaagaaaattgttaggctgtggtgacagtgtcactgaggagcttttaagagttattttcctaagaacaatatgcaagaccttgcacacctagcccagcttacttgtcacggcttataacccgaatgccatcccactgtccacacttaaggaacacagtgctggcccagcatccccattcccgggtgcactttaggaccaccttgggagctgttaaaaattatggctgggtgcagtggctcacacctgtaatcccagcacttcgggaggccgaggcaggaggatcacctgaagtcaggagttgaagaccagcctggccaacatggtgaaacctcatctctactaataatacaaaaattagccgggcatggtggtgcatgcctgtaatcccagctactcaggaggctgaggcaggagaatctcttgaacccaggaggcggaggttgcagtgagccaagatcacgccactgcactccagcctgggtgatagagcaagactccatctcaaaaaaataaaaaataaaaataaaataattatgcctaggacccagcccagaccgactgagtcagaatctcggcggggagcattccgggtgattctaaggtctgggctctgcggggagcattccgggtgattctaacgtgtgggctgtgctgagaaccacggctttcaccacatcgagcgactgaccttgctccagtcaaagaatcttttccccccttttgctcatgtcactccctcaatctgcttttatgcagttttggctttgtctctccaggcttcacttaaatgctgctttcctaaagcaatctccatattcttccagcttttcctaaaatccactcttggatcagctagatcagctgagaatcggaaaccggcgctgaactgtactagtatcctacagaagcttcttgacctctccgcatccaggcttccacatgccaccaccagcctatttgttcttacaatacatgacccagtcacattcgtcctgttgaggactctcactaactcagaaggtattttcaagcatgtggagtacattacaattttctcttcatggcaaatttccaggagtaatttcttctgattcttaaaggagtgacatttgtctcgagcaataaggattttttgttatcttgtggatgttaggaagcatgtaactaatccgttttctctttatgagtttgctgctacaaagtttaaagccaatctgtgacccactggtggaagatgtggtcattatctgcatgatttcaaatgatttctggctttcttttctatttccaacccacatttttcattatttgctgatggcaagtttaatttgtgctatcttgttgtgcttcccctactaatttattttaccttacattgtttattgaacaatatggtgcaaaagttaaattaaaagcaaatttctcttgagttgtttccaatatttgtgtcaaaattatcccctaatctgtgcttctatagtcttttcttttttcccagatcgcaaccctaatgttattctactttgcttcgtagttagctgtatctcctctttccaattctaagtatcttggaagataatgaacatatatcttatgaattttgctaaaatccataaaaaataaatagaaattggttaataagtgtttatcattgcttgctgctaagaatacagagctaataatacttgctttgaattccaagttcattatgcaccaactggagaccttaagcaactgaatctccaagcctcttttttctaattatgaaagaggaaaaatcgaaaatactgtttacctcacaagattgttaagatgccgaaataatttttgttaagttactttttaatggcgaaatacaacccacatgactagtaaagaaaaggtctagaaagcctcatctgtgacttccttatatacacatgtatacacacatgcgcacacacactgagtctcagacactaggggaaagcttcggcccatgggtaaagaggtaggcagaaatgagattcccgcgaggtcttcctagccaggacgaaagcttccagatcacaatctaagaacagtgggataccactgaaggattttaagcagatgtgtagtgaaattgcatatttcagtcttggaaagtgactctggcttttgtgctctagaaagcatatggatacggggaacgtgacagtgaaggaagcagggatatctgctaagcagctactgcaatagcaaatgggaaagcaagatcagcttaaggcaccctgacatcatgaggtagccacactgagatccaaagctatgttctttcttttttattattattatactttaagttctagggtacatgtgcacaacgtgcagctttgttacatatgtatacatgtgccatgttggtttgctacacccattaactcatcatttacattaggtatatctcctaatgctctccctctcctctcccctctccccataacaggccccagtgtgtgatgttccccaccctgtgtccaagtgttctcattgttcaattcccacctatgagtgagaacatgcggtgtttggttttctgtccttgcaatagtttgctcagaatgatggtttccagtttcatccatgtccctacaaaggacatgacctcatcctttttcatggctgcatagtattccatggtgtatatgtgtcacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatgctatttctagttctagatccttgaggattcgccacactgtcttccacaatggttgtactagtttacagtcccaccaacagtgtaaaagtgttcctatttctccacatcctctccagcacctgtggtttcctgactttttaatgatcaccattctaactggtgtgagatggtatctcattgtggttttgatttgcatttctctgatggccagtgatggtgagcattttttcatatgtctgttggctgcataaatgtcttcttttgcgaagtgtctgttcatatcctttgcctacttgttgatggggttgattttttcttgtaaatttgtttaagttctttttagattctggatattagtcctttgtctgatgggtagattgtaaaaattttctcccattctgtaggctgcctgctcactctgatggtagtttcttttgctgtgcagaagctctttagtttaattagatcccatttgtcgattttggcttttggtgttttagacatgaagtccttgccatgcctatgtcctgagtggtattgcctaggttttcttctagggtttttatggttttaggtctaacatttaagtctttactccatcttgaaataatttttgtataagctgtaaggaagggatccagtttcagctttctacatatggctagccagttttcccagcaccatttattaaataaggaatcctttccccatttcttgtttttgtcaggtttgtcaaagatcagatggttgtagatgtgtggtgttatttctgaggcctctgttctgttccattggtctatctctctgttttggtaccagtaccaggctgttttggttactgtagccttgtagcatagtttgaagtcaggtagcgtgatgcctccagctttgttcttttggcttaggattgtcttggcaatgtgggctcttttttggttccgtatgaactttaaagtagtttttttcaattctgtgaagaaagtcattggtagcttgatggggatggcattgaatctataaattaccttgggcactatggccattttcacgatattgagtcttcctatccaagagcatggaatgttcttctatttgtttgtgtcctcttttatttcgttgagcagtggtttgtagttctccttgaagaagtccttcacatcccttgtaagttggattcctaggtattttattctctttatagcgattgtgaatgggagtttactcatgatttggctccctgtctgttattggtgtataggaatgcttgtgatttttgcacattgattttgtatcctgagactttgctgaagttgcttatcagcttaaggagattttgggctgagacgatggggttttctaaatatacaatcatgtcagctgcaaacagggacaatttgacttcctctttttctaattgaataccctttatttctttctcctgcctgattgccctggccagaacttccaacactatgttgaataggagtggtgagagagggcatccctatgttgtgccagttttcaaagggaatgcttccagtttttgcccattcagtatgatattagctgtgggtttgtcataaatagttcttattattttgagatacatcccatcaatacctaatttattgagagtttttagcatgaagggctgttgaattttgtcaaaggccttttctgcatctattgagataatcatgtggtttttgtctttgggggcagtctgtccgttctcagatctcaaactctgtgctgggagaaccactactctcttcaaagctgtcagacagggatgtttgacgttctttcattttaaagttattatataatcatggattcatttgtctctttggaagcatcttctctgtataagtaattaaaatattttcaagcaaagtactttcacagttctgcaggctgtgcaggaagcatggaagcttctgtttctggggaggcctcaggaaccttccaatcatggtggaaggcaaagggggagcaagaaatctcacatggtgggagcagaagcaagagagaggtgggagagggaggtgctacacacgtttaaacaaccagatctctggcgaattcactcactaccatgaagacagtatgaagaggatggtgctaaaccattcgtgaagaatctgcccccatgatccagtctcctctcacgtggctccacctccaacattggggattacaagtcaacataagatttgggtggggacacagatccaaagcatatcattctgctcctggccctcccaaatctcatgtccttttcacatttcaaaacacaatcatgcctttgtgataatccccagagtcttaactcattctagcattaactcaaaagtccaaagtctcctctgagacaagactagtccctcccatgcatgagtctgtaaaatcaaaaacaagttagctacttccaagatacaatggaggtacaggcattgggtaaatactcccattccagtaggaagaaattggccaaaagaaagaagccacaggccccatgcaagtctgaaacccaacagtcattaactcttacagctccaaaatcgtctcctttgattctatccctcacatccagggcacactgatgctaggggtgggctcccaaggctttgggcatttaacttctaaagctccatatctaaaattaaagatgaatggataactttttactatattagtttttattcttaatgtatttctctttttgtgttttgttttgttttgtttgagacaggatctcgctctgtcaccatggatggagtgcaatgacatgatctcagctgtctgcaccctccacctcccgggctcaagcaatcttcctgcctcagcctgtcccaagtagctgggacacagggcacaccaccatgcccagctaattttttgtattttttgtagagacagggtttcaccatcttgcccaggctgggctcaaaccgttaggatcaagcaatccacctgccttggcctcccaaagtgctgagattacaagcgtgccatctctcctggccctaatttctctttataaaatcagattttgttggaagtatcctgtttgctaaaaccttgatatctgatgcacttagcatagaaatcaggctggaaaaacgaatttgtaatagatatctaaaactaaaaaatgtaagagtcagaagcttaaatttttacctctttttggacggatgtttttctaaaataaacattttcctgccttttcaagtaaaaacattgacaataataaaaatgtcccttaatcatcctgaatcattagatattagttttattcttcatgtaattgactcagtggtgtttaggactagtggtctctaacttcaacaagtgtgggatggtccatggcgtgaaaagagggatagggtttgtctgaccctctctagtggggatgacccacggcctttgctgatgcctgaagcctacagcaaggcaatgtgtacaaacagtggcttcaccttccagaacattttctttctctctgttcttagtagttttgacttgtccacaccattcaagctaagtgtcctttataacaataaagttgaaactagcaaaaacgtccaactctgtgtggttcattaaatactatactgttgtgagcaaggatgtaatttttgtcagggatgggcttcccccatgccccctctaagattacataatacccaaaattacataagattacacctaagattacataatacccaaaagaaagggtagccctaaaatagtgatgctgaggagatactagttacatgaaaaatgatcacaaaaacaataagaactcacatgacagatttttcacttttaaaaatgtattttacataatagtttgatataaatacattctatgggagaataatatatatatttatatcaaatatttaacgtctagatttttttaagttaaaataacctccttgagcacccagttacactttctttccttccatatcttctttcgattccacttccctgaccatatgtgagcactgtttgtgctttccaaacattttcctagacatcagcacacacacacacacacacacacacacacacagttcaaatataaaatgctgctttttccaaaaatgtgatcatatcctattaaatgacctgccttttttccacttatctgtgaaaactttttatgtcaatacatatatatatgcattatatatatgcattttatacacacacacacacacacacacacacatatatatctgcctcggtctttttaattgctgtggtgtattacatatcatgtgtaccataattttttttttgagatagagtctcgctctgtcacccaagctggagtgcagtggcatgatctcagctcattgcagcctcttcctcaagttcaagtgattctcctgcctcagcctcccaagtagctgggattacaggcttctgccaccatgcccagctaatttttatttttagtagagatggggtttcgccacgccggccaggctggtctcgaactcttgacctcaagtgatctgcctgcctcggcctcccaaagtgctgggattacaggagtgagccaccgcccccagccttcagacagtatatatttttgttaaatccaattcttcactgttaaagaatactattttacattaatctttgtatatacatgtgactataatgaatatcctttgtacataatatgtgctctttctccctactcatacgtaaaattactgggtgaaaggttacattatatttaaatctgacatatacttgcaaatgccccaccaaaaaagccctgaaatttgaattcccactatcagtttttgaaagttcctattctcttacctcttcctccatgctgaatattatcagtctttttcatttgtcctcatctcatgaataaaaattacatttgtcttaatttaatctgccttattaactagttttatgtgatactaagtataattttctgtcattacatgttttctatcagatttgttatcttttattgatctttatgtgcttgatattatcatagagattaatgctgtattgtaaataattttcccatgatttttcattgtactttttcatgtgggtttttgacatagatgctttagatttttatatagacatatctgtcatttttttctttatgaattcttagcctatgtttagcatagatttttccaatgttgagattaaaaatattttctattctcatgaaatttcctttaacattgttataattttgtaatctatttttatctctataattcatctgtagtttttctggtttgaggtgggaatctacccttaattttttgtttgtgtcaattgataaccagtagtctcaatcataacctttccttattgacttgaaatataatgcgtaacagctgccaaaatgtataggtctataccaattttcttctagactttctattgtcttcctttcatttatttattaatttttgtaccaatgctgcagtattttaattatgtttgtcttgcagcatattctaatctctggtaggacctttccttttactatttaatttttttacttttacctcccacctcaacgtcctgagtagctgagactacaggcatatgccacaacacctggctagttttgtttgtttgtttcgagctcctgtaaaaataataactattatttattggaaaatctctacacctcagggactatgtgaagcatttttacatgaactattttatttaatcctcataatggccctctgagaaagtgtaatgagttgaatgatggccactcagaggatatgtccatgtcctaactgctagaacctgtggacgtgacttttgttgggaaaagagtctgatgatgcaattaaggatttcaagatcatatcatcctggattatccaggtggatcttaaatccaatgacagttgtccttataagagaaagtcagaaggagatttgatgcagaggtgattgtgtatttagaaaccccatcgtctcaacccaaaatctccttaagctgataagcaacttcagcaaagtctcaggatacaaaatcaatgtgcaaaaatcacaagcattcctatacaccaataacagacagggagccaaatcatgagtaaactcccattcacaatcgctataaagagaataaaatacctaggaatccaacttacaagggatgtgaaggacttcttcaaggagcactacaaaccactgctcaacgaaataaaagaggacacaaacaaatagaagaacattccatgctcttggataggaagactcaatatcgtgaaaatggccatagtgcccaaggtaatttatagattcaatgccatccccatcaagctaccaatgactttcttcacagaattgaaaaaaactactttaaagttcatacggaaccaaaaaagagcccacattgccaagacaatcctaagccaaaagaacaaagctggaggcatcacgctacctgacttcaaactatgctacaaggctacagtaaccaaaacagcctggtactggtaccaaaacagagagatagaccaatggaacagaacagaggcctcagaaataacaccacacatctacaaccatctgatctttgacaaacctgacaaaaacaagaaatggggaaaggattccttatttaataaatggtgctgggaaaactggctagccatatgtagaaagctgaaactggatcccttccttacagcttatacaaaaattatttcaagatggagtaaagacttaaatgttagacctaaaaccataaaaaccctagaagaaaacctaggcaataccactcaggacataggcatggcaaggacttcatgtctaaaacaccaaaagccaaaatcgacaaatgggatctaattaaactaaagagcttctgcacagcaaaagaaactaccatcagagtgagcaggcagcctacagaatgggagaaaatttttacaatctacccatcagacaaaggactaatatccagaatctaaaaagaacttaaacaaatttacaagaaaaaatcaaccccatcaacaagtaggcaaaggatatgaacagacacttcgcaaaagaagacatttatgcagccaacagacatatgaaaaaatgctcaccatcactggccatcagagaaatgcaaatcaaaaccacaatgagataccatctcacaccagttagaatggtgatcattaaaaagtcaggaaaccacaggtgctggagaggatgtggagaaataggaacacttttacactgttggtgggactgtaaactagtacaaccattgtggaagacagtgtggcgaatcctcaaggatctagaactagaaatagcatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccatgaaaaaggatgaggtcatgtcctttgtagggacatggatgaaactggaaaccatcattctgagcaaactattgcaaggacagaaaaccaaacaccgcatgttctcactcataggtgggaattgaacaatgagaacacttggacacagggtggggaacatcacataccagggcctgtcatgtggtggggggtggggggaaggatagcattaggagatatacctaatgtaaatgacgagttaatgggtgcagcacaccaatatggcacatgtatacatatgtaacaaagctgcacgttgtgcacatgtaccctagaacttaaagtataataattaagaaaagacttagaaaaaaagaaaacgtgctacatatatgccatggaatactatgcagccataaaaaaagatgagttcatgtcctttgcagggacatggatgaagctggaaaccatcattctcagcaaactatcacaaggacagaaaaccaaacatcacatgttcttactcataggtgggaactgaacaatgagaacacttggacacagagtggggaacatcaaacaccggggcctgtcgtcgggtggagggagaggagagggatagcattaggagaaatacctaatgtaaatgacaagttaatgggtgcagcaaatcaacatggcacacgtatacctatgtaacaaacctgcacgttgtgcatatgtaccctagaacttaaagtataataataatttttaaaaattaaattaaaaattttctattcagtaatatagacactagataaaagacacaaactatcttttaatgaatggctggtctttggaaattgtaagggaaagttccaggggcctacagaaaaaatagtgagctgaaacaagacagtgcctccaaactagaagacttcaggaagggtatatgattttgtagtctgggctcaaatagtttaaggtagaactttctatccaggaacttgttggaactggacaaaccttgtgacatgtgtttcgggactggtggagaaagcaaggcaaggtcttttagtattgatgaacacaatgttttggtgagaatcaagctgtttttcctaataagcaaaggatttttttctgacaaacaaattatttgcccacataaattgatttgaaataatttcctaaagcaagtagtgaagttatttattggtttgcagacttatctttctggggaatgaatttcccagagaaaacggtaaagttttattaacagagaaaataagaaaattgtttgctcttccatcacatttaaaataatatatatttaggcccagatgtagtgcctaacacctgtaatcccaatagtttgggaggtgaggagttcaagaccagtgtgagcaacatagtgagacccccatctctaaaacaaacaaataaaaacaagaatacatatctaaactggtgggaataaaaataatgagaatacatatctaaactggtgggatgcagccaaaagcagactttaaaggcagactcatgcactcaaacgcagcgacgaggccaggtgcagtggctcacgcctgtaatcccagcactttggaaggccaaggcagaaggattgcttgagtccagaagttcgagaccagcctgggcaagagagtgagaccctgtctccacaaaaaaaaattaaaaaataaaaataaagctagccgggtattgtggcatgtgcctgtggtcccagctactcgggaggttgaggtgggaggattgcttgagcccacaaggttgcggctgaaatgagccaagtttgcaccactgcactccagcctcggtgacagagcaagaccctgtctcaaaagaagccaacaagccaggtgtggtgcttcacgtctgtaatcccagcactttgggaggcaaaggagggtggctcacttgagctcacatgtttgagaccagcctggacaataccgtgaaaccccatctctacaaaaaatacaaaacttagccaggcatggtggcgtgtgcctgtagttccagctactcaggaggctgaggtcagaggatggcttgagcctgggaggcagaagctgcagtgagccaagatggtgcaaatgcactccagcctgagtgacagagccagaccttgtctcaaaaaaagcaaacacaggaacaaatacagagatgagaaaagaatcagagactgtaagtaaattactttaaatgtccaaatttagaagttaagtgaagaagaagaaataacctaaagagagtaaaagaaagaagataacactaaaatcagaaattaataaaatataaagccaagatataattagcagagacagtggggcaacactaattccttgagaagactaataaaataaaattgtttttaactttattaatattagtaagggggtagcgaaacaacaaaaagaaatataatgtctgggtagtcccatgaccattaggaaatgtggaatttttgagaaacttatcacaatgaaaaaattagactcaaaaggctttttgttttgttttgttttttgtttttttactgtggtaaaatacgtaagaaaagttaccatttggctgggtgcggtggccgggtacaggatcacacctataatcccagcactttgggaggctgaggcaggcggatcatctgaggtcaggagtttgagaccagcctgaccaacatggagaaaccctgtctctactaaaaatacaaaattagccgggcgtggtggcacatgcctgtaatcccagctactcgggaggctgaggcaggagaatcgcttgaacccgggaagcagaggttgtagtgagccgagattgtgccattgcactccagcctgggtgacaagagcgaaactccatctcaaaaaagaaaagttataattgaatcctttttaagtgtacatttctgtggcattagacacattcgcattgttgtgcaagtataccaccatccagaacttttccagctctcccaactgaaactctgtacccattaaacaccaactcccaacctcccgtctcccagcctctgacaacccctattctactctctctatgaatctcactactctaggaactttttatgaatggactcctgcaacatctgtgcttttgtgactggcctatttcacttagcataatgtcttcaaggtatatccattgtgttgtggcatgtctcaaaatgttctttcctttaaagggtgagtgatattccattatctgtatattctatattttgtatatccatgcacctgtcagtgggcacttgggcagctttcaccttttggctattgtgaataatgctattatgaacatgggtgtacaaatatttgtttgggtccctgctttcactttttttggatgtatactcggagtggaattgctggatcatgtggttattctgtgtttaactttttaaggaatggccatatagttttccacagtagctgtaccatcgtacattcctaccaacagtgcacagggattccaatgtctccacttcctttgaacacttgttattttctgggttttgatagtagctatcctaatgggtatagagtggtatctcactgtagttttgatgtgcacttccctaatttagtaatgttgaacatccttgcacgtgcctattgattatttgtgtatcttcactgaagaaatgtcaatgtgtgttctttacctatttttaattaggctgtttgatatttgtgttgttgagatgtgggagttctttatctattctgtatagctatcaatctcttattagttatatgactgacaacgcccagagagctttaaaggcaagttctaccaacttttaattgcaatcttacacaaattagttcaaagaataaaaaaaatggttaccctgaaactcattttataaaggatgtatccatcagggtttaaccagagaaacaaaatgagtaggagatgtacacttagaggttgattgcagggaactgacttacatgattgtgggcgctggcaaggcacatcggaagtccacagcacaggccatcagaaagaggagggtgggattttaggggtgaactgaaattgctgtccataggcagaatttatgttttctcagggaagcctcagttccgctcctgaggtctttcagctgattgaatcagtctcacccaggataatctagaatagtgagacaataaatattttacaataatcttcttaagtaatgtcgactgattgtagaattcggtcacagccacagaataccttcacagcatcacctgatttagtgtttgatggaataaccgggtaccagcgactggccaagtggatatgtgaaactgatcatcgcaaaagtcaaacaacctatgcaaaggccagaaaatgacagtttcaaaaactagcagccaattttagtcactaattcagattagaaatccccccgcaaaactacacataacaataacaaaaaaggccgggcgcagtggctcacgcctgtaatcccagcactttgggaggcagaggcgggcggattgcctgagctcaggagttcgacaccagcctgagcaacattgtgaaaccccgtctctactaaaatacacaacaattagccaggcatggcggcatgcgcctgtggtcccagctactcaggaggctgaggcaggaagaattgcttgaacctgggaggcgaaggttgcggtgagccgagatcacaccactgcactccagcctgggtgacagagcgagactccatctccaaaaaaagaaaaaaaaaaaaaaaaaaagtaacaaactagatccagcaatatgtgaaatggaaaaaaacaagtccaaaatataaatatttatcttgtatgaaattctagaactaaaaaacatttgaccccttatctctttaaattgtacttcaaaaaatatataataggggctgtctttataatagagtaatatgtttattgtatctgttttgaagatatactctgaataatcccttgttccacagttcaaatctgaggtaacactgaagacagaaaacaatggtgacattatccccactcccttaaggccagccctgcaatgatccggcattggaaatgctgctgctttacttcactaaatgatactttgttttgcaatttactgtgaattacatagcttaatctacgcaataacaatcctgaaaaaagaaatgtttctggtttatttctggaatttaaatgaaactggtgcttttatattcatatttgtgttaatgttttctagcatcaaagtacaaatccatttatcctttttaataatactcataaacatgaatatctgaactaaaaccttcacctataaaattagacaaatgggggaaaatattgtaaaagcaataatagttaaagagatattgaatttggctgggtgcggtggctgacgcctgtaatcccagcactttgagaggccgaggcgggtgaatcacaaggtcaggagttcgagaccagcctgaccaacatggtgaaaccccgtctctactaaaaatacaaaagttgattgggcatggtggcgccttcctgtaatcccagctactcaggaggttgaggcaggagaattgcttgaactgggacccgggaagcggaggttgcagtgagccaagatcgcgccactgcatcccagcctgggctacggagcaaaacttcatctcaaaaaaaaaaaaaaaagatattgaatttaaataggatttgtcttctcaataactaagtttattattgccaaagtggtattttagttgaagaattagaataagaagaattcaaactaaatagggcaataattgtctagaatactgaaagagaaaagtgcttattcaacaaatatttatggaatgatttttcttagtgttaaggacaacagattacagacaaataagatataattctctttttaaagatctcacgagtctaataataatctaaagaccagcatataaacatacaatcatattactatgtaataaatggtataaaaatatgcacagggtgttataaaaacatgatcatgtgggaagaagataaatcagtagcaactcctgaaggaaatgataccaaatctgtatcttgaggagaaatcacccgctagctcagtgggaaagtgggagacgttccacacaaaaggaacggtttgaaaatgagaggaaagtggacgctggagaaaattttccaaaaacattttatctctgtagaattgggtatgtgtggcgttttccaggcaaagtgtttaatcaaatggattttctgaagattgttaaactttctgtttatgttatgctaacaaagaatgcagtttcccaactgttccacaatatactacttactgagagggtgtctctccttatttctctcgtggaactagtacaaggttaaacctaccattttctgtagtgggcacccagtaagttgtctcactcccctgggaactgcactcccttcccctcccattctaatgcggctcacaggtgctactgtgttctttgaaaacccaaaaccctggccagaattcaaagacagcagtatgggcaactgactgtagccgggctaatcacaatacttcagtccttgtcgactggatttgcgatgggaacttaggctaaactgtatcaagaaagcccttttccagatttgtttgtttggaacccaaaaaaatcaagcaaatgcctttctcgtgtctgaagctctacagttttcctgtgagcataaacacagctacatagagagaatgaacttacagagacagaaacagaagaaaagaatgccaggatcagcttcatcccacaagacggaagtctattccagcaggaaacatctggagtcttcccttaaacctcccttttttaaatgttgtgagttttctttctttagctttattcattcaactagcaagcaaaacctctgaacatccagtttcaaaggtttctgccaaatgccctggctgtttagcttttctttcccttccctcattctgtctagctacaatcctcttgacaaacagagaagaaaggactggggtcacacgggagtagatgttcatttattacaagggtaataatgaaatgaatgatgagaataattataacttacatgcccatactcagaaatgatatgagctaaaaaaaaaaagtgaaattgtcagaatatgttctgtatgaacagttacccttccggttcttggggaactagcagtcacccggtgactagcctttggttgctcagagaacaatattgtaattctgtaatgaattctgtaattataatattgttctctgagcaagcaaaggggagactaaatgtgtatggtctccttggaagcatctcaacttctaatcatttaaaaattttacttcctcactgagaatgtaacctgtttgtttcccagtctttcgaagtgttaactgtctatctgctatgagccagttaatataatacatgtcaaatttaatgtgctaaccttgtactcaatataggagagacaattaaggttctccagcagcagtaagacattctctgagacagcaacagcccagtcaatgtcagctttcaagctggtgctggcctgatgctggctaaccacctgagagaaagctcgccaaggagaggtccacagtgggaggcaggtcatatcagatagcctataagcttttctcctactttcagataaagactcaaatatttattgattggcatatattttataaatatatatatagctagagagagagagagaatgttactacacaagggaacaatttatcaaaaagctgtcctgaaatcttcaaattatgcaaaggagctggattaactttgctggagcctaggatcaatcccacccaggtgacgtgtcctacactcagtgagaaatttttatgataatcttgtttcgatcattataattactggaaccttaataacaatattcaagtagtattcatctcttattacaatgcatgactggggtgctttaattggggcaaaaagacttgagaattctgaacactgtctctgtattgacggttatgtacagcttcttgcatgccatcttccacaataaatagactggatttaaagttatttataatctcaacttatagttccttcattctaagaagctagtaacaatacttagctactctagttataacaaaataaccttcatgctggtcaattctatatgctcttttttccatctttgcttcctttctatattattcaggactccttagacagcgcaggatagaaatatacattaaaccagttcaagcaatagaatggaagttggttggtttgcaggactaaaaggaatactgatgaagctcacaaaactggaagaagccctgccaaaaatcgaggcttggaaggcagagttcagtatggccaggagctgttatctggtgcatccacctcacatctctgcttggctttatgtagattgactttttccaatgacaggaaaagcgagtgctggtgacaacaaatttacagtctcccagctaagcaacacagaagaaagatgcccggaaaagccctggctggccctggttggcctgaacgcccaccccgtaggccgataattgaggtcggtgggatgcagtcatattcctcactaggctattttgttgggggcaaaatgctctggggataagactggggaaagatgcatatcgtacagggaaactagaagcaatacatgaggccaggtgcagtggtgcgtgcctgtaatcccagcacttcaggaggccaaggtgggaggctcgcctgagcccaagagttcaaggctagcctagctggctgtggtggcatgcacctgtggtcccagctactcaagtagctgaggtgggaggatcgcttgagctctccaggttgaggctgcagtgagctgagatggcacctctgcactccagcctggatggtagagtgagaccctctctcaaaaaaaggaagaaaaagaaaagaagcaatgcatgagggcagtttaagagctatcatcttggccctataatactgctcaaaatacaatctttgtgcacagaggtttgatccattggcttctgtggctttattgcctccaacatatctttaccatcgtgtctgccattggatatagattgctgcaattttctgtcccatcaaaacaaatgctggtttcgctgcaccctttccacagaaatgaatatcactggaaacttgaaatggtgtatgagagattctacaaccctttgccactttcggctgctcattagaaatgaaaaggggcctcttttatgcagtactctggcacatcaggtataataccgtgaatgttcttccagcacgagtagcttaggacattaatgcttaaacacatcatgctcagtatcttgtgggtaatattcaagtttaatgtaacatctcatttgtggctgtctaattgcatgacattttccatttctttcctcagttaatactgtgatacagagtgtcttctttttatgggacaatctctcctctaaactcatgaacaatgtgcttattgtttgtgttaagataatgcttttccctcccagctgtaacattccgattgttttattctacctcggaaggcctaagatgacctcttcgcgtgcagatctcagtccttcgctgtctgcggacctgcctaccctttgctgccttatgagagacttgaccttcaacgcctcgttagcattatgggtctctagtccaccaccagcatctaatccccaatagcttatctttgccattctatgacctagtagctgaactttctcactgtggctgccctaacagagctaaactcttgacaaacccataaagcaattgatttttttgtttggttttgtttcttagtggttctctgcttgaaataaagacatttaagggtattcatctttctctgtccaaaagcctagccactccgataatctcattttaaggccaggcacagtggctcatgcctgtaatcccagcactttgggagactgaggtgggagaatcacttgaggccaggattttgagaccagccagggtaacgtagcaagagtctgtctccagaaaaattaaaaattagctgggcactgtggtgcacacctgaagtcccagctaccctggaggctgaggagggaggatcccttgaaccaggaagttgaagctacagtgagctatgatggcaccactacactctaagcagagtgagaccttgtctcttaaaaaaagaaaaaatgaaaaagaaaaaaaaagaattttattttaaacacccttgttacaacatatcaacatatttttgtattttgtggtttttaacctccttttgttgccgcctactaatagatttaaaaagttctggtactgtgatcaaaattccttagagaagaagaaataaaccaacgctgtttacttgtaaatccactttgcaaagggagaatgagaggatacactttaaggacttagaagaaaaaggcaataattatgtttgttttacatcagcatttaaatcaaaatgaaaatgttgctttcataaaaaatgaaagcaataatgttttaattaacgggaataccaattcttctaaaaataaatatttttctgtaattactgttaatttttttttctttaataactttcttagctcagaaaggagcacagttatatgctggatggtttataagcacagctttaaaatgtcatgattttttgcagcactgtaacctacaaaaaaaaaaataataaattgtattgacaaggttttcatgcttaaacctacattttattgtaccattatccctgaacaaattgaggcacaatatttcattagactggacagatacattattgaacatacaagagaatattaaaggccattcaatagttttagcaaagaggatcagtattaggttttgtaagtttgtgtaaaagaataccttctatatcatggctatatcttttatattaggttagttttttgttttgagacagtcttgctctgtcacccaggctggagttcagtggcgccatctcggttcactgcagcctctcccacctggattcaggcgattctcccgcctcagcctcccgagtagctgggattacaggttcccaccgtcacatccagctaatttttgtatttttagtggagatgaggtttcaccatgttggccaggctcgtctcgaactcctgacctcaggtgatttgcccaccttggcctcccgaagtgctgagattacaggcgtgagccactgcacccagccttaggttcatttttaaaacacctaaaatgaatttattttaaaggaatgtattttaaaggtatttttttataaggactttaatatttagagtcattatatttagaaaagaagaggttcatactcatatttacaaaatacatctcagaaatggattctgagacagttctaacaactgttctatgaagttatatattacttattataatagatggcatacaatttagtgacagtaaaatatctgggattgaaattccacccaaacactcccccattttctgccattagagatgttcatttgtcacagagaatctaaaggtttataggacttttataagaggaaaaactgaatatttcatgtaaatattaatcataactaactggagtggctatattagtatcagacaaagtagacttcagaataggtaatattaccagggataaaaagggacattacatgatgataaaaagggtcaattcatcaagacaaggtagcaaccctaaatatatgtcaactaattatagagcttccaaataaataaagcaaaaattgataaaaatgaaagaagtcagcaaatgcagttgttactggagacttcagcactcatctcagtaattgatagagcagacagaaaatcagtaaggatatagatttgaatggcagtaacttgaccaacctgacctaaggtgtctgggtagaaggttccactcaatgtcaaaatacacatacttttcaaacgcacatggaacatgcaccaagatagatgagcagtgcctctccaactgtggtcgggtatttaaacctaaatgttcaatactgatatgaaaagtatttgttcactggacaacagcaaccgatgatggatatccttggattccagttgtttctaccaatcttgacctttactcctttgcttccaagtggtcttacaagtaaagcaaatctcagacatgcttggttgctccgacagatatctaatagcaagtaagcagtaagacagccatatagcctcttaaccactctcagtcctcagatgccctgacaagcacatcaaacaaaaggttcactccaaggcagatgcaatgatattttgttgataggatcagaaaacttcctgaggttcaatagtcatccattgagggtgggatcacaggattgaagggagcccgaccccaagggactacttggatgtgggtcttaaacaggttcttataactcctttcttcaagggtagtagagcctgtaaaacctctctttcccatcacatgtctagaagtttgctaatttcaccaatgaaatcatttttcctctattccttgtgctaattcacaatgcctgtggtttagatttagacatcaatatttgaagtcttgctgagtctacctctcaagtgtagattgccaattgaggcagttcaaatgctaatcagccatctataaggtgtagattaaagttaattcacactgacacatatgccacactctatactaattatcaatacattccatcagatgaatcagcagtatataaatcagtatgctaaaatatattaaaataatttaaatcaatttaccaaaaaaaaaaaaaaaatctcagagcagtcaaacaaatttatgttagcaaaaggaaatcagaaatcatgagattttcaacaaaccaacattggggtaaaaaattttcttttcacattttttttttttaccatttcttaataattattctctaactaccactctagtttttctaataacaaagagcaaattggctgtctgtacgcaatagaacttacctttttttcttttattctttttttttttttttttgagacagattctctctctgtcgcccagactggagtgcagtggtacaatctcgcctcactgcaacctccacctcctgggttcaagcgatcctcctgcctcagactcccaagcagctgggattacaggctcacaccaccacacctggctaatttttgtatttttagtagagacagggttttgtcatgttggccaggctggtctcgaactcttgacctcagatgatctaccagcctcggcctcccaaagtgctaggattacaggcgtgagccactgcgcccatcctagagctcacctttttttaaaacatgtattacaatgctgtgtttgataaaggcaataaaaatgtttaaatcaacatttgtttgacagtagaatttcaattatcttaattttaggagtataggaaaaacattctcattgcaccatgtacaaaaaacatcctattaacataggacatattgttagatgcaatagggttttatcaatttttttttatttaaatcatggacggttacatcattaaattgtattcactggattgaggcgttgaagaacttgtaacctcccacatcccaattttaacacctgctctttgctcttcattttgtgtatgccaaggttagttcatcattcaacttccacagcgacttatctatttataatgcttggcaaattttccaaggatttcctctagtggtacagtaaaatatgctatcacaggcctaatttttctttgaaggcttctattttatcttaaaaccccgtgtgacttttgtatgtaaatacacaatgtcttcttcgccagaaccaccgggttggttgccgtctgagctgtgcctcctcgtcaccgccaccgctatgcctggaggtcggcttcttggggacgtggctcccaactttgaggccaataccaccgccggccgcgtccgtttccaggactttctgggaaactcactgggcattctcttctcccaccctcgggactttaccccagtgtgcaccacagagcttggcagagctgcaaaactggcaccggaatttgccaagaggaatgttaagttgattgccctttcttttttctttctttttctttttctttttttgagacggagtcttgctctgtcgcccaggctggagtgcagtggtgcactcttggctcactgcaatctcggctcactgcaatctctgcatcctgggtttaagcaattctcctgcctcagactcctgagtagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgataagaagccgaagctgtctatcatctacctggctaccactggcaggaactttgatgagattctcagggtagtcacctctctccagctgacagcagaaaagagggttgccaccccagttgattggaaggtggggatagtgtcatggtccttccagtgattcctgaagaggaggccaaaaaacttttcctgaaaggagtcttcaccaaggagctcccatctggcaagaaatacctccgccccacaccccagccttaagtctcttggagaagttggtgctgtgagccagaggacatccgctgccaatcatgttttcctgctgcaattccatgaaaacatcctggtgtcatcacaccaaggtttttaggttgctatactactggcttattaaatgaaaactggcactaaaagtttcttgggattctttacactctgtcttcaccagcattcaattctgttcatacatcagcactctctactggttctctttgaaatatgttctgtatttaaaactcaaatcttgttggatctctgcagggcttgtgaccaatgaggtcatatttgttgatggttgagaaagcttgcttccctccatcagagaatgactatccctccatcagagaatgactatcaatttttttaactgtcctattacatcctgtcttcagtcacccattttgaagagtggcagaacttgaggttcaactcctctgtaaatatccaagtataaaacccaggaacttagagtaacccagatgttctttaatactgtttggatcatagccgggggaaaaaaaactttttaattctgtacctttctagtagataactgaagaacaagggaagagacctttaaatattttgctataaaaaaatttttttgtggccaggcgcagtggctcacacctgtaatcccagcactttgggaggcagaggggggtggatcacgaggtcaggagatccagaccatcctggttaaaacggtgaaaccccgtctctactaaaaatacaaaaaattagccgggcgtggtggtgggcgcctgtagtcccagctactcaggaggctgaggcaggcgaatggtgtgaacccgggaggcggagcttgcagtgagccgagatcgcgccactgcactccaacctgagcaacagagtgagacttcatctcaaaaaaaaaaaaaaaaaaaattgtgataagtttctgtcaaaatggggagactgcagaaaaggcttcccttggcttccaaggaggtgtagcaggggtgagcaatcctagtgccatgtgcctttcacacagggtttgcctttatcagtctgctttctgatgacgtgtacatgaaagagtacaccatgagacaggaagagagaatgactgaaaatgttttattgtagaactcttcttgcagtaggttttgctatgttctggattttactttttagggaacaacaaataaaatcctttgttaaaactgaaaaaaaatacacaatgtatcaatgtctattttgacgtaaatgttaatatttaaaattgcggttgcctaaatcactttcagtttctgtatgtgttacccaaactaatttggaatcaggaacttagaggatacttctaaaaaagacatgagaggtcattgtgaaggatgagaaatgttccatgaactcactggtttttactggtagccctaaggggccgtatcattctgtttctcaatgcctgtctcagtaagaagcagaggaattttgtaaataaatatttgctccatcaatagaagcaggattaattctatatggaacaacccagtgcatgcaaggatctgtggagtttcctttattcctaaaaagccagtctgcgggcactgtctcccaggtttagacctggaagttttagaaagctatgaagtctcccactgtagaaaatagaactgtttaatgcaatctgttgctcttttgtgataaattgccttcttggaagcaaagcaagagacacctggatgagggactacaaaagctgcagaagacaatgtaacgttagttgcccttgggaagaaaactagatgacttgaggtcaagggtaaaagacttccttttaccattgaccttgtttcattttactgtttgtaccatttacatgtattatcccttttagaaaacagattcataataattttaaaataagttattttgtgacttcagaaaagagcagcaaataacatttttgtctcatttatcataatttaagccttgagggtctcacccaggcagctctgatggagctcaaagtccagctaaacaaagcttctatgcctgacactgcttcacaattgagcgtccacacagtcagtccttgcagcagaaatgagagaatgtatacaaatggaaaggttggggtcaagggacccacagccttgaacaagctccctttcgtgagacagagaggggacagaatatataagtatttactcatatatgcagaaacagtccttggaaattatggatgcctaagacctacagtaactgacattatattcacagcactgggttgcatttaataagtggaaaccaagcataatttgcttttcaacttacttatattcattgaaggattatccaaattagcaaaaggagcatccagtactaaattaaatctattaatgcctaccacaacacacacgtatttgtttgagatagaggttaggccgtgatactctaacttctaggtagaggctttgcagtattcttttcttcccttgtagaaatggaggatgagttattataggacattcatcagaatcagttctagagccttcaaacagaaactcaaaaactataagtgaccttttaatagtagaagaaaagtaggacaatattctctctctcctcacactcctctaagtgagcaagaactttcaaactgtggccacttgtatcccctgaagtaggcctcttcatgtgatcagttgttttgtggggtggagggttgtattcatacacttgctcagattagctctatgcaacaaagctagtgaaactcattgcgttgatcttagacatccatccacctgccggctctgttgactaacccatgtggctgtaggttggtgttacggatttgtaaattaggcaatcctaagacatgggtgctaataagacgtagttgaacttgggctgccttcccgtgctggtattgagaaagcgctgtagccaagactcaggttcgcgacgtttacgcccacgaagactcgggttcgccatgtttaccctcacgcatctacaacagtcctggatttttatggatcactgttcgcaatgtttacactcacgcatccacaacagtcctccatttttacggatcgcctggattttattaaaatgcagattctgattcagcaggtcgagggcagggtctgcatttccaacaagatgatgctgacacagctgggccatgacccacacttttagcagggctgagcccctcagatggtgtctggctgcagagactttcatacattttgaaatttcaggcatgagattttgaaaatttgaatacatgtaactatactacctatccaaaaaatagcaaaagttatacaagtgaaataatttttgttgaaaccccagtattctctaagagtcaggcagctgagtgaaaacatgggtaagatgagcagtaacaggccctctgtaggaatcttgcctttgagttggaagctttttatcatgctcatcaagaaagtttcctctcctagcacctctgcccagccgccccgtctgggaggtgtacccaacagagacagcgaccatcgagagcgggccatgatgacaatggcggttttgtcaaatagaaaagggggaaatgtggggaaaagaaagagagatcagattgttgctgtgtcagtgtagaaagaagtagacataggagactccattttgttctgtactaagaaaaattcttctgccttgggatgctgttaatctataaccttacccccaaccctgtgctctctgaaacatgcgctgcgtccactcagggttaaatggattaagggcggtgccagatgtgctttgttaaacagatgcttgaaggcagcatgctcgttaagagtcatcaccactccctactctcaagtacccagggacacaaacactgcggaaggccgcagggtcctctgcctaggaataccagagacctttgttcacgtgtttatctgctgacctttcctccactattatcctatgaccctgccacatccccctctccgagaaacacccaagaatgatcaataaatactaaaaaaaaaaaagttagtgtaaaataaagtagtagctttccaatatacaaacaatcaaatgatagatataatgatgtaacaaaagatgtacataacagtgattaaaatattcttaggaatatatttaacaataaaaaaaaaaaagaaagtttcctctcctgaacctcggctacaccgctcttcacagaccaaattgaagcttcactgagaatggcttcagaggatttcctgaacacaataatcatttttttctattttagatgttttgcttccagaaggcaaaaaaaaggactaaatgaacctccgagcagagcctatatgatgattttgcaggaatattaagatgggcccccccccactattattcttagcaaactaaagcaggaacagaaaaccaaatagcacatattctcacttataagtgagacctaattgataagaacatgtggacacaaagaggggaacacacacacactggggactctgagggtggagagtgggaggagggagaggataaggaaaaataacagaatctccgcttagttcctgggtgatgaaataatctgtacaacaaaccccgtgacataagtttacctatgtaacaaatctgcacatctaccctaaatctaaaataaaagtttaaaaaattagaaaaagaaaaatagccaggcatggtggcgtgcacctgtagtccagctactcaggaggctgaggtgggaggatctcttgagcccaggaggtcaaggttgcagtgagccatgattgtgccactgcactccagcctgggtgacagagtgagaaattacctctaaaaaaaaaaaaaacgagaaggtgggcctccccgtggcatgtattagaaaaagtgcgccctctggatggatgaggcccctggatagatggtgctgaaacaggtcagggacactggtctcattgtccaaggtgttatccaagctcgttgtctcacaaccaaaagaattaaggagcgtggacacagagtgaggttggagcaaaagtttaatgagcaaaaaaaccaagctctccactgtgcaaaggggagcctgagtgggctgccgtttttacagttgagtccaaaagcttttagaagaaactcctctcatctatgtagctgtttgagtaacttctcttatgtgaaaagctgtctgtaaaccccaccccttatccacgtagttgcggatatgactctaggcaagcacaatgcaccgcttctcttgtccgtgtaactgtgggtttgttttagggaagccccctcctctctgtgcaagttcccacggagcccaccgtgtacttgtctgaaaagaaggggaaacttttccctgggagctggttaatcacacgaagaacaaaaggcttctgtgccggaccttgcgtgcttgcctgtgcaggtgcagcctcagttttccccaggctgctctatttttgcctgtagctgcgatttttcaggcaggctgcttctccaaggaccagccttaactgtttacctaactgatttttcctttgcttctccctcagtgctttacacgaagaaaaagatgcccttcctcacaagtgtacctggcccacagctcaaagagcagagcttgggttggatttgtgaagggcaccatttgaccaccaccggggcagcccatctaaaactctcccagtcagctcatactaataaggaaatcttgtagaaaatggacagtaaattagaggcaagtgttcacaggaagcagtcttcttatttgcttttctaatccctctggtggcaagagagcctgagtgccgggagttcagggaggcggagaggctgacagtggcgcaacatggggctccattttccctgactctgccttggaagtctgccgcttggtgtctggtctttatacctgatacagtgtttgccttgtgttatggctgagttatatcccctcacccaaatttacatgcagaagtcttaatctgctgggcatactggctcacgcctgtaatcccagcactttgggatgccaaggtgggaggacggctcaaggccaggagtttgagaccagcctgagaagcatagtgagacctcgtctctacaaaaaaaagaaaattaaatttctaattcccagtgactcagaatgtgtctgcatctggcaataagatctttaaagaagtaattaagttaaagttaggttattagggtggtccctcatccaatctgactggcatccttatacgaagaggaaacagggacacagatacacacagacagaggactgagtggagacacaaggagaattcggccatctacaggccaaagagagaggctggagaaggagccaaccctactgacaccctgtcctcagtcttccagctccagcattgtgaggagatgccattgtgtgatgtaagcctcccagtatgtggtaatttgttatggcagcaggggggactgaaacaccttgccgctagaccttgataatttataagaaaagtcagaggtaaatgcttgtgagattatcgggaaaggatgcaccatgattagacccacaaaaggtcctctccactcccccacttcccctccccagtgcaagtccacccaggttgacagcgtgggcttgagtggaaagtcggcagcagcaacggaggcttgaagctggccttcctaacttgagactctccatgttttgattcaaagccaggaggattcaatgaccgcagtcattgcagggtctgaatagccaagaaatgcttggcttcatacaaagcactatatacggacctgtgtcaggcgaactgttgaaacagaagagacactgggagaaggcttttcccatttctccaaccactgcttcagaaaatctctgatatgcagagagtgattatttctccttggtctttctgggatgtttgaaggagaagtgaccactcctcatgcatttttcattctatagccatttaagtctattgctgccaggaaaatgagggaccgactaaatgacttctaattaaaaatataggaaagcttcaagtgacttcatgaagaggtcatggcaatatagtgcattagtaaatcaccgcaactccccagatctaggcaaataagcatagatctatttattcttgaatttttttttcaggatatgagtcctctgcccaaatccaaaggcctacttgaacacagtttcagttcctttcttctttcccagataacatcagtgaaacaatttatgttcttcctcaacaagaagaaagccaaactcttctgatactatttcaacaacccttattgctccactcacagcctccctcaggtgaagttttttctccctttctccaaacctttgccttccttctgcctcctttgtggctaaaattaacgtactgcctagaaccagacctgtcaccttctgactcacattctcccataaaggtactgaaaagccttaagaagattcatgaagcatcattagacaattaaaactgtcaatatgaaaaaaaaatgtggccagacacggtggctcatgcctgcaatcctagctctttgggaagccaaggcaggtggatcaccagagatcaggagttcgagaccagcctggccaacgtggcaaaaccccatctccactaaaaatacaaaaattagccgggcagggtggctcactataatccactgagagaatagctttgctgtcctcctttctctatggaatgccaaacacctgtgctatcttagactagtcacaggacttgaaactagcccaattgtcttatagaactgatgcttacggtttcttttgaatccacatagaaattgaccttcccagtcttaaaatttgagacagtcccatttgtcttttctgagttcctttctcaggaaaccaaccatcaggcttcctagatagtatcaaggagctgaaactcaccagatcactgcctcttgacaatgagatgccagacccctcacccatcatgactacctaaacggccaccggcttcctgttgaccaactctctctacttatcctttcctaactcctgttctcccacacagggttacatttcttccttgctatataacctccagctttggttggtcagggagacggatctgaggctgatctcccatctcctctgctgcagcacctgattaaagcttctttcttggagatactcatcgtctcagtcattggctttctgtacagcgaacagcaggacctacactgaagccctggcgttttggtaacagattcaatgatgtctcttcaaccaagttgcttattttcaccatgcagtaaaaataagtaccataggctgggcgcggtggctcacgcctgtaatcccagcactttgggaggccgaggtgggcggatcacaaggtcaggagattgagaccatcctggctaacacggtgaaaccccatctctactaaaaataaaaaaattagccaggcgtggtggcgggtgcctgtagtcccagctacttgggaggctgaggcaggagaatggagtgaacccgggaggcggagcttgcagtgagccgagatcacgccactgcactccagcctgggcgacagggggagactctgtctcaaaaaataaataaacaaataaataaaaataagtaccatataagccttgtttagataacttgtttcctttaacccactctttatgggttaaaggacaccccccactctcagcttcaatctttgccccataccactctcattatccactcttactaacagccatttgtttcactttattggattcagcttctctatccatagacatggtttctactgcatggctcctgaaacttaaatgtgcatatgaattacttgggtattttattaaaattttaatttacttcagtaattctggagtgaaggctgaaattctgcattcctgtcaagctcccaggtaatgtcagtgttgctgatctgaaattgtacattggtttaaaatagtctattgtaaccctttgtagggttttcaggttccaaacacaggctctgggagttaaattatactagtaacttatatatcacttctgccaaataaatagccaaatcaatccatcaatgaatatttgttgaatacctactccaaagtcccctgtaaaatattttcttcttagtttggtagatagtttcgaaagcatttaccatttcaagtgtttgtttgtttgtttttgcaacagagtctcactctattgcccagactggagtgcagtggaatgatctcggcttactgcaacctctgcctcctgggttcaagagattctcttgcagcctcagcctcccgagtatctgggataacaggcgtgtgccaccacgcctggctaatttttgtgtttttagtagagatggggtttcaccatgttggccatggctggtctcgaactcctgaccttaggtgatctgcctgccttagcctcccaaagtgctgggattacaggtttgagccactgcacccagccaccatttcaagttctaaaagacttatctctaaacctttcataggcagtcagtattcttcccctttctccttatctcctcatcaccaaggtttttttgttttttgtttttgttcttttgcaacagagtcccaatctgtcacccaagttggagtgcagtggtgcagtcttggctcactgcagcctccacctctcaggctcaagcaatgctcccacctcagcttcccaagtagctgggactactgacacgcaccaccacacccagccaatttttgtatttctagtagaaatggggtttcaccatgttggccaggctagtctcaaactcctggcctcaagtgttctgcccacctcagcctcccaaagtgctgggattacaggtgtgagccaccacccctggcctaccaagttttaatataagatttataattcaattgtctgaagatgggcttcagagccaaagaacatttccagtgttctcaagctacattcattcattcattcaataaatatttactaagcacacactacatacttggcactgtttcatgtactgtttactgataagcatagaacacaagacaagcaaggtccctgaagctacaaagctcagaccccaaaagggtaggaaatgaacaataaaaacataaaaaataaataatttcagagagtcaaaagtaaatgacaaaaataaaacagcataattcaatgggactaagaagcactactttggatagggtaactggggaaagcctccctggagtgatctcatcagagctgagatgtaaatgacaagaaggtgccagcctcagaaaggtctgaaagaagaggttctaatgatctaatagtcatgatttgctctgtagactgctttcctgagagttgcagttgtgtgttccgtgttccctgggtctcactgagcgtgtctgaaaaggccactttgcaaatacagtggtgcacaattacctcctgtttttgtcatcatttttagctctttccaaaaaaagattgatggagactgcctgcatgaggattggcttatcggggatacagggcagacagtcagtatagatttccatgatccgggagaaaattatctgtagaacattacaactaatcatttattcctggaaaggagggaatattttctttgataagcacttactgagcacttataacatgagaataaatgtttatatgtgtataaacagatgaaatatgggtctgtagagatgaatatgacatggattttgttgtcaaggagcttacaaataaacacaaagtaaaatggaaaaagtgagaaactggaagtacagggtaacgaaaataatcactttgaaggaagggtgactgatcttggccaagagaatctgtaaatgttcccatgagcagtctgtatttgaactaaggcttgaaataggaaacagaggagccatatccatagacagtacgaaaggccatagaaccgggtaagacacttagggaggaagtggaggaaagaagaggctcaagggctctgcccctgcacaacctggttaatagccttgaaggtgataatgcacaagaaatgcagatttcaaccatgtcagaggacgcacaggtccagcaagatgaacaacaaaacctgacctttggtttgaacattgtggaggtggtgtggtggctgggagcacagatgtttccgcgaaggggagaaagaaaaggtttatcaaagtggattcaagagaaatatgcaaggagaactgaaaattggcaccacagcccagggcttctcaaactttaaagtcactgtgaatcctggagatcctgctggagtgcagtttctgatttataggtcctgggtggaaactgagagtctgaatttctaccacaatggcgggtgacattgatgtcactgatggatcacaatttgaatagcaaaggaagagagtatttcaggagttttatattaaaaggagcaatgaaaaggactgggtgagcaaagtaactagaggaggatgtgggaccaaggatattatttttaagattcatgctatcgcagcattgtatgccaatggggatgattcagcgttcagagggggaaagtcaaaatggggagcgggataactgaacatcgtccttgagtagcgtggagaaaggggcacgcagcgatcagtgaaggggcagctctggagggaagcccagccagttcgtgcatgttaccaggggcagcagaaagctcctgcgcatagaggcaggtgagctggacgctgcacaggggttctcttctgttgttatttctcaatgcagtaaggcacttagctgctaggactgggaagaggaagaggcagcagtatgaaagaatcatgaggaagtaaattgactagggcagtggtcctcaaccccatgagacccatgaccctttttgttttgtttttgtttttgttttttgggacggagtttcgctcttattgcccaggctggagtgcaatgacgcgatctcggctcactgcaacctccgcctcccgggttcaagcgattctcctgccccagcctcccgagtagctgggattataggcatgagccaccacacccatctaattttgtatttttagtagagacgaggtttctccatgttggtcaggctggtctcaaactcccgacctcaggtgatctgcccacctcggcctcccaaagtgctgggactacaggtgtgagccaccgcgcccggcccatgaccctttttataacacatgcttttaacaaccttgctaccattgtgaaaataaaataatagtttatgtaacctacctacacacacatttttgaatcaacataattccttcaccgtaatgtaaagaaagaaaagaaaaatcgttcaggcgtgagtgtactgttgtgttaggaaggcgaaagcatctccacaagcactgtgagtgcttctagaaggcagcgagaatatctgaggcttggtgagacgctttcatcgccatgactaagggtccacccgcagttaccggttatgatttcatgggagactctcagttgtacattttgttcagctgcttggatgcaagctcagaggtggcagagttgcatttaatcaggctggcagctttactggggagtaaatggactgaaaatggtgcaaggaagcttaaggtccaggtctacaatctctatgtgcaattccaaaatccaaaagagctttgaaaatacaagttggttgttggtggttatccaaaactcatttggcagtgaaactcagcctgaatagacacaaagctatttagagcctttactgatcccacttatttgagatactacataacagtagaactgattatctttctacaatttttttaaaatctgaatttggaaacatctgtgcccttagagcttgggataaagcattataaactgtacatgtaagggaattaataaaatgacgggccaggtaagccaaggcaggtcagataggaaataaagacttgagcagttaagacacagtgaaaaaaattgggccaccggattccgggtccctgtatggcagattgtggggtggaagtgctagaagtgagacaggaagcctgggagatacagagctggatgctttcaactgagaatccgaatggggtacagttacagataatgacgagtgcagaccctacagtagctgaggatgtcaaggtgaggacgtcaagaataatccatcgcccagggatggcggcccatgcctgtaatcccaacactttgggaggccaaggtgggtgagtcacctgaggtcaaggagtttgagaccagcctggccaacatggtaaaaccccgtctctactaaaaatacaaaaattagctgggcatggtggtgcacatctgtaatcccagctactcgggaagctgaggcaggagaatcgcttgaaccctggaggcggaggttgcagtgagccaagatcacaccactgcactccagcctgggcaacagagactccaccaaaaaacaaaaaacaaaaaaaaaaaacaaaacaaaaaacaaaaaaaaaaacacacaaaaaacaaaaaaacccagaacaatctatcagaagaaggatccatgtggatgtgagattagcactgggcatttaacatgtgactgcctcaaaagggagtggtggccagtgtcgtctgagagcttcagctgccgacgagctgcctgctgacaggtgtaggaagcagaaaggtcgagcgtgaacaatgggaacaacacttacccatgggggtgacatctaaagagaaagcagcctccacccgaccctgcttcaggggaagccacgtcctcgggtcggttaggaccaaaagatgaagaatttagggatgcaaaatattttgctgataactgccaaggggatcagaagacacagaggaagaatttgggggattctgcagggttttgagcctgggtcatcccaggaaatgtacagagccatgtgaggatgagactccagtgtgggaggatgacctgggggtgtctgcctcgccacctgccatgactgggataaaatggagtaactggctcagtcctaatgatacgtaacagcagcatttttgcaaaaagagctagacctgctcataagattgagtagttcagaggtcagttaactctttctgggccagataataagtattttagattttgtgtcacaattcctcaactctaccattgtagcaaaaaagcagatatggccaggcgtggtgctcacgcctgtaatcctagcactttgagaggccaaggtgggtggatcacgaggtgaggaatccaagaccagccttgccaacatggtgaaacaccatgtctactaaaaaatacaaaaaaaaaaattagccaggcgcagtggtgggcacctgtaatcccagctactcaggaggctgaggcagaatagcttgaacctgggaggcggaggttgcagtgagacgagattgtgccactgcactccagcctgggtgacagagcaagactccatctagaagaaaacaaaaaaaagcagatatatctcacagataaaggaatgggcatggctctgttcaataacatcttatttacggttactgaacttttaattttatataatttttaatgttatgaaatattatttttcttttgattttttgttcaaacatttaaaaatgtaaaaacttttcatagctcatggcaggccaactttggaacatctgccatagattgaagacctctggcatagtttaatatttagcgggaaaagcggaaaaagagattggaaccagattagtgtggttgtcaaaaaaaaagctaaagtgtttggacggggggtgtgggtacgtatgctttagaatccattaaaaattgttaacggaggcaaaagatacgatctcattagtgttttaggaaaataggtggttgcaataaaaatgatggattggaaagataagaaattagatgtgaagagtcagcttagagaccttggcacttctatagggggacatatcaatgcctagagacccctttgcttgagaaagcataagccattgaatgttattagaaataattaaagtggtaacattgaaaagatactaaatatacaattttactttctctccgaacacactgtaagtaggaaaaagcatattaacaaaaacagcaatctaatgtcctgaaatagacctgtgaaaaggcttgcaggtaaaagaaacacaaggaagacacagagacaggaaggaaaagaatatttaggcacattaaagagatttaacccacaggactaggactcacacagtaagaatatgatgctggtaaagaaatggggcttcacacaggggaagagttcagaaaaaggactgagggttgtggtccaagatggaaccagagaatttgagaattcttttctatgacaatttcaaaaatcactttcccttcttgaaatgtatgattgacctttctgggtgaaaccctacgggctgggggaaggagaatcacctcctaggggttatacccgggaaggcacaggggagacgcattccaagtcctgaagagctcctggattgggccagcaagacatacttttagcatccttccatgacagtggtttcttgactcttttttttttcttgactctttcttaagaaaagaataaaggtacacccagaaccccattggatacctactccttgtttgcattcattagagaaaggactctcagcagtggtgaagctttatcagtaccctgcagaaaatccactgaaaccaaggtccctgcctcttagttcacgataggcacagtcctccaagcctgtttgcgcctctcttgcattctgatttactgcttgctcctcacttacctcctcctttgtcctttgctgttcaaagactgcacttgtaaattgggtaattcgagtttgatcctgggctgccctctcttctacctatactcatccccaacattagggctactaataccatctgtagtgaaaagggtcacgaagaaaataagccaaggggatatgatagagattgactgagtcaactcaggcacattggccccgatgtcacacttaagctgagatcagaatgcttggaataatctgggacatagaatttcagacagaagaaagacaaatgcaaaaaccctgttgccagttagaaagatggatgtagctggagaaaattctgacatagttcattactgcttcactgcatcactttcctggggatgggacagcacggcatgcctgaagagctgaggggctgcactggtttctttatatcgactacatcacctaagtcaacctgttctaaggcacatttggtggattctttcagctaaaaaaaaaaaaaaaagaagaagataaaatatttaagttccaaatcaaatatggtttgagtccctgatgctcacatatttactcatattgatccatttccaattacacacataaacacatttttcaaacctttctgaccattacaaaatgctggtcactacccactaattggttccaacttataatgaaaatcatagatttaaatcctaaaattaaaagaaaactatacataactgtgtgtcccacaactgcttattttatacctttttctttgcccaaataaggtggaacctgtattatttacaggctgatatcatttgttctcatcatttcagacataatataaaacaataaccagttctacaatttccctatttagactatatagaccttgtaaaacctggaggctccaatgtgcctcaatgatattttcctggacagatgtgcattttaaagtattggtttaaaatccacattatggatacaaaagacatctaaaggctgatgatatgatataaaatacatccctaaaagccaagtaattccatgtaggaagggataatattgaagtttctgaaagaaaggctttcttacaagcggtgattcttgatttgagtcttgtaaaaggtataaacttggaatgggagggtggtaaattttatagaaagggtgatattagcgaggatatcgcaaggcgtaaattatactttctaggctagaactggaatgagattgtggagttcatatctgtgcattagctgtgtcctaaatgcaaaatggcctcctggatcaaatcctagaagaaataaaaagtacatgagtggaaaagcatgatgaagaccaaataaagtctggagcttggttgacaggattgcaccattgttgattctgtattttgataaatgtacattggttgtgtaggatgttaacattagcggaaactgggtgaagtatatatggaaactcaatgtactatctttgcaactcctctataaatccaaaggtatgtcaaaataaaaagaaaaaaagaccacaccgtctgaggttgactcaaaagattttgagggaaaatttgagtgatggtctaaaacaaaatggagcaagctcagaaaatttactccagataagcccaattttagtaggtttcttagcagaaaggcaaggggtgtttggggaaagggaggttatgggaatagttgtcttagtctgttcagcctgctataaaaaaaaatttgagtaattcatatttatttattatctttttgagatgaagtttccatcttatcacccacgctggagtgcgatagcacaatctcagctcactgcaacctccgcctcccgggttcaagcgattctcctgcctcagcatcctgagtagctgggaatacaggtgcctgccaccactcccggctaatcttttgtatttttacaaaagattgtctctttagtagagacaaggtttcaccatgttggccaggctggtctcaaactcctgacctcaggcgatccacctgcctgggcctcccaaagtgctgagattacaggcgtgagccactgcccccggccaagtaatttttaaacaacagaaatgtatggctcataattctggaggctgagaagtccaagatcaaggtgccagcagatttggtgtctgccgagggcccactcctcacagacggtgccttctgtgtgtcctcataagatggaggggaaaagggctcccccacgcctcctttataaggacaccaactccattcaccagggcggagccctcaggacttaactacttaccagaggcctcttgataccatcacatcggggcaggtttcaatgcatggcttttggagggacacaaacatgtaaaccatagcaacagtccattcttaaaaagaagaaaaaatctggccaggcgcagtggctcatgcctgtaatcccagcactttggaaggccaaggcgggtggatcacctgaggtcaggagttcgagaccagcctgaccaacatggagaaaccccgtctctactaaaaatacaaaattagccaggcatggtggcaccgcgcttataatcccagcttactcgggaagctgaggcaggagaatcacttgaacctgggaggcagaggttgcagtgagccgtgatggcaccactgtacttcatcctgggcaacaagagcgaaactctgtctttaaaaaaaagaaggaaaaatcttatgaaactgccaaacataacattaacaaatcactgtcaaagtctgaggagaatctggggtctaaaaaatagccttaggccctatacttagacccactgctaaattctcacagataatcaaatgagaccatatttatatggttatagctttcatgtaaagagcacaaaagtttttgaaaatatacaacaggacgataagtctcattcttctcagtgtgaagtaccaaaaggcttccatgtagattttagattctacttagattgttttttgaaaagcagagttaaatatgccttttaaaaatcatactctactaagatatcaaattccaagtggaaacatacattactgactggtgggttattctttttttcacagaaactctaaaaatatgtttaacaagctctttaggccagttatggtggctcacgcctgtaatcctagcactttgggaggccgaggcaggtggatcacaaggtcaggagatcaagaccatcctggctaacatggtgaaaccccgtctctactaaaaatacaaaaacttagccgggcgtggtggcgggcgcctgttagtgccagctactcgggaggctgaggcaggagaatcgcttgatcgcttgaatccaggaggcagggaggcggaggttgcggtgagccgagattgtgccattgcactccagcctgggagacagagccagagtccatccaaaacaaaaaacaaaaaacaaaaaaacaaaaaacaagctctttaaacaactgactgaacttggcaaattaactttatctttacattttgtatcaggatagcaagatttgggttctaaactctgctctgtaaactaatacctatagggctttgaataaggcatttgtcactactgacttcacatttcctcatctataaaatggataataacaatccctaaggtgctatcaagatcaaacaagcatgtaaaaaggcattacaaatcatagccaataataacatggagagatttcttaaatgaaaaatacaactacagagtttgcaaaataccttaatgtaaaatactatattagaccacagtgacgcatatcaaaggagcaagatgggttcttttgttgttgtttttgtttcatttatttttttatttttttattttttatttttttatttttattttttttttattgatcattcttggatgtttctcgcagagggggatttggcagggtcacaggacaatagtggagggaaggtcagcagataagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtgcagaacaaaatggagtctcctatgtctacttctttctacacagacacagcaaccatccgatttctcaatcttttccccacctttcccccccttctattccacaaaaccgccatggtcatcatggcctgttctcaatgagctgctgggcacacctcccagacggggtggtggccgggcagaggggctcctcacttcccagtaggggcggccgggcagagacactcctcacttcccagatgggatggcggccgggcagaggctgcaatctcggctctttgggaggccaaggcaggcggctgggaggtggaggttgtagcgagccgagatcacgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcacgcctgcaatcgcaggcactcggcaggctgaggcaggagaatcaggcagggaggctgcagtgagccaagatggcagcagtacagtccagcttcggctcggcatcagagggagaccgtggaaagagagggagagggagaccgtggggagagggagagggagaccgtggggagagggagaccgtggggagagggagaccgtggggagagggagacggagagggagaccgtggggagagggagaccgtggggagagggagagagggagagggatttttgtttcatttttttcgtttgtctttggagatggagtctcgccctgtcgcccaggctgcagtgcagcggcacaatttcggctcactgcaacccttgcctcctgggttcaagcaattctcctgcctcagccttccgagtagctgggactacagacgcccgccaccacgactgactttttttttttctttttttttttttaattttattagagacagggggtttcaccatgttgcccaggctggtctccaactcctgagcttaggcaatgtgctggcctcggcctccaaaagtgctaggattacaggcatgagccaccacgcccagccaacacttgggttctaatctgagtttagaaacttattcctgtataaagtttctttgtgcctcggggttattttaaaacgcaaatgaaattataataacagtaataataactattttagaaatttgatttcagataaaatgagactgtgcgtgtattcaatttatattagctaaatcaaatagaaataagctgaagctctaataatgaaataatgttttacaagtttaaggttaataagcatttatagataaggcatgttttcttacaatattccgttcccagggctcctggactgaagatcgaagttcttcccatggcctacggggtcccagagtctgggcctgcatagcctctccacactcgcctccactcatctcaggtccttccataactattccctctcctgtcagggaggctctgccgtccacgctgattcctgcagatcagggaaacctcccctaacttcccggctctcctatgtggctcccacagcaccacgcacctctccttcattgtgctaataatagctgcattgtgacacttacaatcatgattatttggctggtatcctctgactgtctttatttacaatgtggatattttgttctctataaattgttgcgttgattttgattcttttacatgccaggttaaaatattactaatactgattactgagggtgttttgtttacaagtgagttactcacctcaatctagttcttaccctcctgttctgacctggccattccgcattcaaaccccaggaggccaggaatacgtatccaccagggcctagaacctccgcctgtgtaggggagaaactcaaatctgtatagagtgaattaatgcatatctatagtttttgcattttaagggttttaaggaaaatattgatttgtaacacagataaaatggtcgaaatacaagtgttttaagtgaccatgatgttactggcagaagaatcactatgactaaaattccagcaatggacaacactttttctatgcataacctctttgtggtcaatttcaagacagcccacttctgtttcacggtttaattggttctcgagctcatttaggagaaattcaatttcctttgagctgagttcatatcacaacagatgagttcattcgttttggtttcttcttcaggcccatggaaaggaaagctaaacgataatgggagcaaaaataatctatggaagaggtggagtgtgaaatgtaaaattagattttctaaacatgctgtctctaatgcccaaacagagccacacccaagcgatcaaatggaatcagtggtaggggaggcgattataaatcaatctagtttatgggatgcactgtgtgaatggttaagggagtgataaagggtggtttccgacaacccaaagaaaggatcctcggcttgagctaagtgtgtgtgtttccatctagtgaggaaaggggctttcaatgacattgccacttaaaggcttacaaagaaggttctggtcaacattcttcggttcattgaagtatttcttatcgaaacccaaatgttaacatttttatctccaagggaaacaaaaaaaaaggctggtggaattcccctgtagtttctaaagaggccacagcaaggcgccatagagacagaaggagggaagttgagggaagtccttctgactggtaaatcggctttctgaccctcgtctgcaaataatacattctaaggtaaggaactaaggaagctttattgaaatcggatttcaaatggagaggtcctgctatgcctactggaggagatcagggaataataaatatttccttcattgaaaattatatcctattggccaggcgcagtggctcacgcctgtaatcccaacactttgggaggccgagacaggcggatcacctgaggtcggaccagcctgccaacatggagaaaccctgtctctactaaaaatactaaattagccgtgcgtggtggtgcatgcctgtaatcccagctactggggaggctgaggcaggagaatcacttgaaccaaataggcggaggttgcagtgaggtgagacggtgccactgcactccagcctgggggacagagaaagactccgtctcaaaaaagaaaaaaaaagagaaagaaaagaaaggaaggaaggaaggaaggaaggaaggaaggaaggaaggaaggaaggaaggaaggaaaattatattttattggccaacctcaaaattgaagcttattcagaaacagatttaaaaaaagaaaaaagtggagaactgctcccagatatatatgcagaaaagcttcaagtcaacatttaggaggtttttaaatatcgatctgggtttcgttctaatggtctgggtgtacttatacgacctattacatttcactagactgtagccaatagtgagcgttgactgaccattgctttcaaagtgagttgtgttgcctttagcaatacagtcacattaatggccagaaaaagaaaaaagaaaacaaacactgggggtgtttgaaacaactgggggtagggtggggtgggaaaggtgtgggggtttgcgttcgagtcaacctctatttcggggggtaaaaactgcctcctccgcttgatttttttcctcgatctgcaaaagcgtaaatgttttgttttgttctattgagatggagcctcgctctatcacccaggctggagcttagtggcgcgatctcggctcactgcaacctccgcatcccgggttcaagcgattctcctgcctcagcctcctgagtagctgggattacaggcgagcaccaccatgcctggctaatttttgtatttttcggtagagacggggtttcgccatgttggccaggctggtctcgaacgcttgacctcatgtgatccccccgtctcggcctcccaaagtgctgggacgacaggcgtgagccaccgcgtccggcctaaaagggtaaatgtgattacacccacgcgtatttgttcaacagacatttattgagcgctcaccacgtgccaacgccgggcgtctgggctctggaggcgctgccacgtggcggatgcgcagtgcccggcggccgggctgaggggtgaacgcgggggtcagggggccccgggctgagggtttgcgtgcgggccgggtgcctgggggccccgggctgagggtgagcgcgccgcccaggtgccaggcggctccgggcagagagtgaacgcgcgggccaggtggctccagggcggcgccccagggcggggccggccacgccctccctaaccctggcggagctgatgggtggctgtagcctgattagaccgcgtcagtccggagggtgggtcttgggagggggcgcagggcagtccacgtttccactgcagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagatttttctgttctccccaaatccattctccatgcagctgtccggcccatcttctaacctaaaaaaacttgctgtttgcttgttggaagccctgtaatggtttccttgggacctgggatgaaatgcaaatggtcccggggctcaccgtcagccccgcgcctgggcctcgccccagcccccaccttcctgcccgccatagctgtagggagcatggagcatggagcgtggagcgtggagcatggagcatggagcgtggagcatggagcatggcctgcagcccccggggagcgccggcagcctggaaccagcaggcttcgctcgtctcttcccacccccgtgcacttttcctcctgcccacatctggctccgatggccccctccttgggggccttttccagacattcatgatgaaggtggcgtcctcggttacttcccctctcatattcttttttttttttttttttttttgagacagagttttgctcttgtcgcttgggctggagtgcagtggcacgatctcggctcactgcaacctccgcctcctaggttcaagcgattctcctgcctcggcctcccgagtagctgggactacaggcgcccgccaccacgcccgactaattttttttatttttaatagggtttcaccatgttggccaggatggtctcgatctcctgacctcgtgatccgcccgcctcggcctcccaaagtggtgggattacaagcgtgagccaccgctcccggtcccaccccgccccgaccttttttttaatagcatttttctcaatctgacattttttgtttatttgccctttactgtctgtcccacaccaaactttgtgttaacgaggaactttgcatctttttccctaagttcagcacctagaacgaatactaaatgtatatgaagatttcgtccacatccgcttttaccagtatgttttccatgtacagtcaagttccatataaggccgtttcagtcagtgagcaaccccacgtactatggtggtcccataagattataaaagagctgaaaaatccccatggcctagtgacatcttcatgatcctgaatttgtgtaggcctaggctcatgtgtgtgtttgtctcttcgtttttaacgtaaaagtttttaaacagacaaaattttacagaataagaatataaagaaaaaatatttttgtacaggtgaaaaaatgtttgtgttttaagctaagtgttattacaaaagagtcaggaagtttgcacatttttaagtttataaagttaaaaagagtctgggcgcggtggctcacgcctgtaatcccagcattttgagagcctgaggcaggcggatcgcctgaggtcgggagttggagaccagcctgaccaacgtggagaaacctcatttctactaaaaatacgaaattagctgggcgtggtgacacatgcctgtaatcccagctactcaggaggctgacgcgggagaatcggctgaacctgggaggcggaggttgctgtgagcggagatcacgctgttgcactccagcctgggcaacaagagggaaactctgtctcaaaaaaaaaagtaaataaataaatgaatttaaaaagttacagtaagctaaggttaatttattattcaggaaagacaaatttttaaataagttctaaaatttgcctaagtgtacagtgcttataaagcctacagttgtgtacagtggcgtcccaggccttcattcactcaacactcactcactcactcatccagagccactaccagtactgtgagctccattatgggaatgtgcctacacaggtgtaccattttttatcttttgtacagtatttcttctgtttggatatgtttatatgcaaatacttactgttgtgttacagttgcctacagtactcagaactgtaacatgctgtggagatttatagcctaggagccatgggccctactgtgtaacctgggtgagttgcaggctgtgccattcgggtctgcgtagctacactctgtgatgttcacaggatgacacagcaacctaaagatacatttctcagaacatattcctgtcttcgagtgatgcatgactagttatttctgctaacagaaattggcttgccatataaatagttttcttttagtaaattaataaattaccatttcaatgttatatgtcatcctcacaagcttgtatactgctatgagaaatagcataatgctcggagatctgacaaataagaatttagcttagaaaggtaaggaccatacttgaaccttagtaaattcataaagaaaacacctctcttaggagatgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaattcaaaatccaaaatggtccaatgagaatttcctttaagtgtcatgatggcactcaaaaaggtttcatactttaagcatttcaggtcctagattttcagatttgggatgcacaagctgttttttaaatggactaattggggagagcagctctgtgtttaatcctagtaattaccctccaaaggtgctaatattgtgcttcataaatattttgagatctccctggttaatttcacctctatatttttgttttctttttttttcttttttttccgagaaagtcgctctgttgtccaggctggagtgcagtggcacaatcttggctcactgcctccgcctcccaggctcaagtgatctcctgccagtagctgggattgcaggtgtacgccaccacatccagttaatttcttgtatttttagtagacagggttccgccatattggccaggctggtcttaaactcctgatctcaggtgatccgccagccttgtgctcacaaagggctggcattacaggcacgagccactgcacccagccctaatttcacctttttaaaggacacaggcctggcgcagtggctcacgcctgtaatcccagtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggctagaggtccaaaacccaggtgttggcagggttggttccttctgaggctgggagggaaggactggcccaggcctccctttttggctttaagtgactgtctcgtgttcacatggcattcaccctgtatccccacatcccttcactctgcctgtgtccgaacagggacaccagtcatgtgggattatcacccgtgctgatgacctcatgttaacttgacaaactctgaagaccctaccttcaaataaagtcacattctgaggtactgaggttatttgtactaatgtacaaagggatctgttcaagaatgttaactgaatagtatttttaatagtgataaacccataacgtaaatgttcattaaggggatatgggctgcataattcatgccacttttgttcaacagcaaatgtgcaagtctccttcagggagagggtcacagctggaggcaagccacaaagaggaagtttcttgttactaacagatgagacgggatctggtgtattttcttgctgtggaaggaaattcagagaaagtagttacatacggataaagggagaaattgtctgaaggtagctgatctaatgtaggggttaactcatttttatcattattaagtgaatccctgattggaatcatctcataatggccaaaaatatgctgccatcaaacttgaaatgcttatttgattttaagatttaagacatctctggaggtagtgctaagtgtaccattaatttaatggcttttcaggaaataacaataccacactaagtaaatatatcaaacttaagattaatcttgatttctaaaatgccaaagtctaaaatatgtctttaaaacaagtaaaaaaaatcaaaggcttacattttgacgtcagtatgagctaattgctactatggactatggaaattacttcttaatttggtctagaatttctagtatcatttttacaggaatgtgggtactgagtgaggaacactgggtacataatccatttgtaagtggaatttcctccaaatcaaacacctgagtatagaacttgagatgggaatttggtatttgatcaagatgacaaagcatattctcagctagttttgctttcgtagcactgtgtttgatttgctcttctgtgggtttctacttcagagatgaattagcacagagcacctctgaagaccaggcaaaaggcaggactgaatagcagccctcaaggccagaggaagtcaggggcagggtttaggctgcaagctggagagccgagatgcagggcaccgagagggatggatggagatgcttcttcctgaaccatgagcatttctaaaaggtagatcagcctttacatagcgggagccagtctccatccctcttgctgttctcagatggctgttcctgttcagctcttttctagagctgaagggtccgaaactccctgttaacaactctaaagcttaaatgtgtaagaaacagcaatctgagaaaatgcttgtgtatctggatcccaaggcttagttaaatcctgactgaggaatagggtgctacttagctagcttcctagctgttcttgtttttgcttttcttccaaaaaggaaccctaaaactgctaagaatgtaagaggatgcatgtggatgcaatgtggatgtaagatgcatgtggatgcaatggaaacaaaaaaaaaaaaaaaggaaaaggaggttagctaatgaggatatatgaggatatgtcacctgaaatcctttgtttatggttcaggaagaaatgtacatagactctccacatttgtgttttaagtaagaacgaacacaagataacctgaacacatacccagagaaaactgaaaaaaagtctcagttcatctagcttttcacctttccaggcactggcatttgacagaccccaaatcctgataaatgaataaaatgtttttcggttttcaagctggcatttggcttcatggcccataaacaacaaacagaatcttacatgtgtagggttttttacattttttatcatgtttgtttaagatgtatgtgctgggccaggcgcagtggctcatgcctgtaatgccagcactttgggaggccaaggtgggcggatcacctgaggtcaggagtgcaagaccagcatggccagcatggcaaaactctatctctactaaaaatacaaagattagcctggtgtggtggtgcgcacctgtaatcccagctacatgggaggctgaggcaggagaatctcttgaacctgggagggtgaggttgcagtgagcagagatggtgccactgcactccagcctgggggacagtgtgagactcttgtctcaaaaaaaaaaaaggtgtgctgttttgatatgcatatagtgaaatgattactgtcaggaaaattaacccatggcctggcgcggtggctcacgcctgtaatcccagcactttgggaggccgaggtgggcagatcacgaggtcaggagatagagaccatcctggctaacacagtgaaaccccgtctctactaaaaatacaaaaaattagccgggcgtggtggctggtgcctgtagtcccaactactggggaggctgaggcaggagaatggcgtgaacccgggagacggagcttgcagcgagctgagatggcgccactgtactccagcctgggcaacagagcgagactccgtctcaaaaaaaaaaaaaaaagaaagaaagaaaagaaaattaacccattgtcccctttttcagttatcttttgtgtgtgtagtaagcacctaaaatctactttcagcaaatttttggtaatgaatactacattattaactgcttcttcatgctgtgcgttaggtttctagacccatgctatctaactgcaagcatagacccttgtctgttgctccctatttctccctcctctacctctgcattcctggtcactaccatttctgcgctgtttctatgtatttgccttttttgtttgtttgtttagtttccacatatcagtgagattatgtagtgtttttctttccatgtttggtttatttttccagtttatgttgtagcaaaggcagttatctccttttttaagtctgaataatattccgttgtacgtatgtgcaccacgatttccttattcatctgttgatggacatgtggattgtttcatttcttggccgtggtgaatgatgctgcaatgaagatggacgtgcagatagcttcgtgcggtggtgatttcatttcctttggctatatgcccagaaagggaattgctggcccatatggtagtcgtacttttagtgttttgaggaattcccatcctgctttccacaatggctgtactaacttactttcccaccaacagtctgcaagaattcacttttctccacatctttgtcaacacttgctgtttcttgtctctttgatagtggccattctgacaggtgtgagggagtgtttcactgtggtttggtttgcatttctctgacaatgagtgccgttgaacacctgttcatatatttgtgtgtcttttgcgctatgtctgttcaagtcctttgcctttttttttctttctttttttttttttttttttttttgagagacgaggtcttgctatgttgttcaggctagtcttgaactcctgacctcaagcgatcctcctgtctccgcctcccagagtactgggattacaggtgtaagccaccatgcctgaccctttcaccatttttttaatcaagttgtttttttggggggtgagttgtgtgggcaccttgtatttttttaatattaactcctatcaggtaaatgatttgcaaatattttctcccaacccataggctgccttttcattttgtggatgttttctttgccattcagaagctttctagtttgatgtagccccacttgctaatttttgcttggagttggtttttgtgtgtatggtgtaagataatggtccagtttcattttgcttgtgaatatctagttttcccaataccatttattgaagagagtgccttttccccattgtgtctttttgtttttcttgatgaaaattcttatatatgcttttgggttaatttctgggttctctgttctgttcctttcatctgtgtgtctgtttttatgctagtattgtaatattttgattactgtagctttgtaatataatttgaaataagggaatgtaatgcttctaactttatttttctttctcaaaatgttttttggctattcagggtcttccgtggttctaagcaaattatagaattgcatcttctgtccaggcatggtggctaacacctgtaatctcaatactttgagaggctgagccaggaggattgcttgagcccaggacttcaaggttacaatgagctgtgatcctgccgatgctctccagcctgggcaatagggtgagaccccttctcttaaggaaaaaaaaaaagaaaaattaaataaaaagattcttttttcattagccgggcatggtggcaggtgcctgtaatcccagctacttgggaggctgaggcaggagaattgcttgaactcgggaggcggaggttgcagtgagctgagatcgcgccactgcaccatttctgtggaaaatgacattggtattttgataggaattgcatggaatctgtagattgctttaggcgatacagacattttaacaatattcttccaacccgtgaacataggatatctttccatttatttgtgtcttcagttttttcagcaatgtttacactttctggcatttgtatctttcacttcctctgttccatttattcttaagtattttattcttttggattcattctaaacgggactgttttcttggtttctttttctgatagacagtaactgctgtaaagaacgacagctgattaaaaaactgaaaatcttaaggcagagtccactgctttcttggtatcactaatacaggcaataggaggcacttagtaaattatggaatgaataaatgtaaaaatggagcttaatatgctttaaaagtaccttaataaaattatcaaaattaaattaaaaatataacccaaaatggccaataaggaaactgttactgttttgttttgttttttttttttttttgagacggagtctcgctctgtcaccaggctggagtgcagtggtgcaatcttggctcactgcaacctccgcctcccaggttcaagcgattctcccgcctcagcttcctgagtagctggaactataggcgcatgccaccacgcctggctaactttttgtattttcagtagagacggggttttactgtgttagccaggatggtctcgatctcctgatctcgtgatctgcccgcctcggcctcccaaagtgctgggattacaggcgtgagccaccatgcccagccgtgttacttatttttatataaaatatgaatactctgaaataaaggtaagcaactttaatagactaacatattctcactaaaagaaaaaaatgtgtctgtgtgtgcatatacatataacacatgcacacatctattcctgttttccaaaagtaatctccactaagagttcttcaattattttgtttgatcatcttcattaatagtgaaaataatcttaaatctcattatcattcctttctgccttccttctctgtaagaggcaggggactgagggtttgttcatcttccagcatcttgaataatgaagaactaaccagtatgaagaattattaccaagactgtattcgatggtgatatcacttacattcctacttgttcaaatcagttgttttataccgtgcgatatgtgcacagctctcccagtgatatctgactcctgtatttcaccacagctacaatatacatttgtggacataggatttacagaattctatctgaaagcaaatttgtcaggttgttatattgttgacaaatactcttgtttctcagatcattttttgctggctatatgcacgtgcaggaatctgtatgtgcttgtgttttaattacctaatgcactggctctgactgaataaattgcatgattacctcctacactggacacagaacagtgcaagtcatattaaaaagccattatatttgcaactctgagcaagagactataattaaaaggcagttggatgaaattagctttgagagtacaagagtttaagcaagatttggtaaatgaacattaatggttaacatgtggtttttattaggtcttttgcttcttctctccataaccccggagttgaatttcttagatgtcagtggaccagacatgtgagaacacctgtacaaagctatactttaccatgtggctaaaattatattcataaaacaagccaacataacttttgtgactttagtaaatcaaaggtattagactagaatgatcccctgggcattaataaactattcttaatgctcctaagattttagttatatgtcattaaaagcatactgtgtgctccatgcaacttaaaatgtttgtcataaaatacacatatacacgtcaaagaagtaataaaacttgagggcattttaattattctcaccgttaaatataaaaaagttaaagttgtatgcagtatgtgtaatagcatcccattcttatctgtttgcagactgttgaggactccgcatggtagtgatatttttgtagaggggaaagctttatggagtatgtgtatgtactcaataggtcttacacttaggcagattaaagatgcctgcaaattctggccgggggcggtggctcacgcctgtaatcccagcactttgggaggctgaggcagggggatcacaaggtcaggagatcgagaccatcctggttaacacagtgaaaccccgtctctactaaaaatacaaaaaattagccgggcgtggtggtgggcgcctgtagtcccagctactcgggagactgaggcaggagaatggcgggaacccgggaggcggagcttgcagggagccgagatcgcgccaccgcactccagcctgggcgacagagcgagactccgtctcaaaaaaaaaaaaaaaaaaaaaaatgcctgcaaattctttgctacttctcccagtgagagtaggggtctatttccttccccttgagtttgggctggtctgtgactgctttgatcagtacagtacagtataatgtaaatggtgctgcaatggttatgccaattccaggcttagtttgtaagaggccttgctgtcttggaaacctactgctagtttgctgctgccttggaaaccaactgccgtttaagaagcatgactaccccaagaccaccctcctgggcacaatccaagccagccacaggcagaggccctgtaggataagaaatcatgtggagagagaagctaaggagcaatgaggtgctgggcttgcaagtgaagaaggcgactggaaaagccatctagcctggatcaccccaggtgacgccacaggagttggtccctttccaagtttctaacccacaaaatgatgcacagtacaaaaagattgccttaagccgcttaatttcgggttagtttgttatgcagcaatgaattacatacaccccacttcaggcttgtttttgaattttatggtccctgctttacatgtgtgtgtatacgtgcatacatatatatacgtatagagagattgtcatatgactatatacatacgtacatatatacatatagaaatagataagattttgtcgtatatctagttagtgcccaagttcaaaaggaagtctttatatttctaggtttatatactagatttattttcagccatatgacaatgaaatagtgagttccctcttccttaaacattaaagactgattctatttggtggggtatctaaggaaactgcagctgcctttagtttactaaaactcagtctctaaagattggtggagggagaatctccacttgggaggaacagtttttcttcacggaaccagttctgaggctgggcctggtggctcatgcctgtaatcccagctctttgggaggccaagatgggaggattgcttgaggccaggagtttgagaccaacctggacaaaacagcaagaccccgtctctacaaaaaaaattaaaaattagccaggcatagtcccagctactcaggaggctaaggcgggaggactgtgcaaactcagaagttcgaggcggcactgagctatgatcacaccactgcaggccagcctggatgacagagccggaccctgtctcaagaaccggtcctgccacctgggtgggtcaccttcttggaggaatatcattaattgctgtcaccacaagcactgtccttaaagggccatgctgcacttcacactctgacccaagcctgagcacctagctctttctttatttcttagtaaaactgagatgaggttggaacatgtaaaggcctctattaacggcaagaaaataataccgcttggattctcaggccacaggcttaagagaggtgcacctgtttcaagatctagagttaagaggctccaatggttcatttctatctgagacctggtttaggtttctggctgggatctaccttactcagtattctaccttacccggtatgtctcactgacctcttcatgaaagtttatctccacgcattgtgtgacttcacatttcacttaacacgctaacaacgtaaacggctcaacagccccaaaacgtagataagaaatgaatacattctttatgaactttttctgtaaatctgctggcgggattaaagtattagatagagtatttaactagaagacccctctaaagttacccaagatgggaatagagaatgaacaagagagagaactttgcccctggcaaggggcagttttgcaggctttgtaacccatcgtaaagggttagaactttgccttgtagtcaataaaggaagcatagaagggattaataagcaagtaagtgacatgatcaaattcactctttagaaaattcatttagggtgcagagttaaagatggattgggagaaggaaaagatgaagctgttgccataatctagaggtgaggtgacatgtctttctggacttagtttccagcacaggcacagagcacagtaagtgattatagatgtttgaatatatgcttgactagacaaagctaaaaggatttccaagcagtagtaaacatagaaaagtgacagatgcactaaacttaaagtcagtgacacacaacaatcaaaaggtaaatacacccatttaaaatgggcatagggcttgagtagacatttcaccaaagaagacagaaaaacaaccaataagcacgtgaaaagatactcaacattattcatcactagggaaatgcaaatcaaaaccaccctcagataccatttcacactctcaaggctgcctataatcaaaacaagaagtattagccagatgtggagaaatttgagccttcattcgctgctggtgagaacgtaaaacagtttaatagttccttagaatattaagcatcgttacataaaccagcagtttcactcccaggtgtataccaaagagaaatgaaaaaaatctgtccacataaaaacttatatatgaatgatcataatagcataatacataatagccagaaagaagaaaaaatccaactgctcgccaactaatgaataaacaaaatgtagtgtgtccatacaatgaaaatttcagccataagaaggtagcactaatacgtgtgataacctggataagccttgaagacatgctaagtgagagaagccagacacaaaagtacccatattgtaaagtagcatttatgtgaaatgttcagaacagacagacccaaaggaactcaaacccaaagagttccccaaagaggttagcagttgccggggcgagggcgtggaggcggtagggagtggccgctcatggtactttttgtggcatgttaagaatgtgctgaaattaggtagtgtcagtgattgcagaactctgggaatgcagtaaaaaccgctgagttgtatactttgaaagggccaattttatgacatgggaattgtatctcaataaagctgttatttaaaaaaaccatttatgcaaacttttatagacttcttaactattttacagtcactttcatcagaagtaataacgcaaaaattcaaacacccaggaggttacacattctgtgttaagaacacagactttgaaatcaagcagactgagtggaaacccagttccatcccgtagaaactgtgtgacgttggacaaatgacgtaacttctctgaacctttaatcatctctaaaatgtaaataatacctatcagacatgttataaaggtgaaatgagacaacagagaaaaaagtcctaagctaaagtacggacatgaattattatccagggtattgttattctttactgtgccaagacaatgacccagccccctgaaggtattacagttttatagcacattctaggtggttgacataaattgccatgtttatgtttccttagtgagcacatatattaacgtttgaaaagtatgttgaggccaagcacagtggctcaaacctataatcccaacactttgggaggcggaggcaggagcatggcttgaagccaggagttcaagaccagcctgggcaatataacaacaccccggttctacaaaaataaaaaaagtagccgggtatgggggcacacgcttgtagtcccagctacttcggaggctggtagaaggatctctttagcccaggaatttgtggctatggtgagctttgattgtgccactgccatccctgcctgggcaacagagtgagccctatctcttaaaaaacaggtggggcgcggtgcctcatgcctgtaatcccagcacttttggaggccgaggtgggcggatcacgaggtcaagagttcgagaccagcctgaccaacatggtgaaaccccatctctaataaaaatacaaaaattagctgggcatggtggtgggcacctgtaatcccagctactcaggaggctgaggcaggagaatcgcttgaacccgggaggtggaggttacagtgagcagagatcatgccattgcactccagcctgggcgacagagcgagactgtctcaaaaaaaaaaaaaaaaaaaaagaaaaagaaaagaaaggaaaggaaggaaggaaggaagagtgcagatgctgggaggcgccttgcactaaggcggctttcatactgtgcgtaggagcttcggtttctcacatttagaacctaaagccattgaaggtagagctctaatattttgtattattttttaaattgctcataagaactgagctcattttcaagaaatacctcaacctataaagcataaataaaaggcataagcaccaaaaattcacgagctctaaggaaccattctggtgaatgcattcttcaaaaaagtagtgcgtttaatcagaggagcagtaagttcaggtttgcatgctgtatctgacacctttgtgtggcccgtggatataagcagatgtgaagcagaaaagagggaaagactggagaattgttggtttggaaataagaaatatggaaagcctggaaaaagcacagttgtcgggataaggaggagagaggaggaaggacatgtttgggttaagtgatcaagctggggccgtacgcggagtgagggagggaggaggaggagcagacaggcaggaggatcctgaggtattcagcttgctggagtgaatggattgagatgcggttgaaggagatgggaactgggaatgcaggaagagaagccagaaggggagactgcatgacagttcggctgaagataagaattattctgaaatggcagttgtgcatgttggaaaaataaatcaccatggaaatgagcctgatcaaatttgactagggaaactgagagttgtacagaactctcattccaaaatgttatcaagtccttaagataatttaactctgtgttgcaaaataggtagacataaacagagaggaaaacagtattttcatacagaacaatgaagaggaagtactagatttaattggacacacgcttctcacatttaaagatggggaggagataatggtgtccctttgtgtccttcccaaagaaatatggggaactgataatgcctcacataagtcttaaaggaagaaaatgtagagcatgcacttttgcagatcactctctcattaacaaacaagctcagaagaaatgtggtctcaatgaaatgcttcctttcttggagcttaaatacggtcaaatctaaatatctaagaaatcaggaagtttgacatctttaaccactaaagattaagacaaattttttacatgtaaagttttatctggatatagggacttcctgatcaaggaaatagttgaaaggaataaaaaaaaacaactgagtcacagaacattccatcaatgaattattgtccaggtttgttcagaagtggtgacactaatattattttgctcaaagtaaataaactgcattgctgactacataaagagagagaagttgtacctttttgcttacctctgttttcccgatgcctagtgtaagttgtctagcacgtagtaagcagacagaaactaactacatatgtggaatgaatgtacgtgggaaagatcaattctgaaacgtgtatagacgagaagtaacaaatattcttaaaatagtacaagaactcatcattcattcatcaaattcgttttaatataaattctttattgaaatattagagacagaaaataagtcataaatgctcttatattccccttacctgcttccaaactttaccttccctaccgcaaaagataatctttctactaacctctaacgccatatttgctgttgatggcatctgagaagtctccagttttcagctattactaacagtgctgtgatgaatattttgtttttttggttttattttgttttagaggaggggtctcactgtcactcagacttggatgcagtggcatgattatggctcacggaagcctggatctcctgggcttaagtgatcctcccactttagccgcccaagtagctggtactacaagcacacaccaccacacccagctaatttgaaaaaattttttagagatggggtctctctcgccatgttgcccaggcacatcctgaattcctgagctcaaatgatcatcctgcctcagcctcaaaacgtgctgggatcacaggtgtgagtcaccatgcccagcctcttctgtatataactagaattgcccgttctttggatgtatatatgatcagctttaaaggatatttttgaacagttttccaaagcaagagaggaaattcctctaaagcattttcttaagtgatgaataggagctttctaatgcattctttgccgttttcacagtgtggacattgacattcatggtgcaaaagcaatgatggataaaccagttggtgccttagaacgaatcaagccagtggcaccaaactgtcttagtagtcattacatactagtagtcactgccatgtatcaaagcaaacaagagccagttttattttttgaatgtcttgatgatgtcggtttaaaaataaataaatagaaattttaaaacttgaaatgttttaatgaagcactaaaaagagtcagttttactacatctcagcccttgagttcacattattatgaagtattttttaatattttctctggtgaaacggacatacgcataaagcgtatctgttgcatgcccaagtacccaagtacaacaaatgtatcaaagaatagaatctatgaaattggtggacttgagagctgacttagctgatttttttcatggaacataaattttactcgaaagaatgacgaagatgctgggtatggttattcagattggggtgtctctcaaaaatatacagacatactcttagaaacaagtgaaatgggcctgtgatctcaaagaaaaaactgtttttggtcagggatagaatttgagttttcacaagaaaactagaaattttaaaaattttaaaaacttgaatctatcactgtgaacttcgcagcttgcccgtactttaaaattttctgataagattatcatgttgttttatgaatataatttttcaacattatctactgaaatatgtcaacatttggaagatctgaataactcagtgaaccaatattttcaatgtatcatattacaaaattatacatgaggagagatccattaaaagtgcaagagataggccaggtgtggtggctcacacctgtaatcccagcactttaggaggccgaggtggttggatcatgaggtgaatagatcgagaccatcctggctaacacggtgaaaacccatctctactaaaaatataaaaaattagtcaggcgtggtggcgagcgcctgtagtcccagttactcaggaggctgaggcaggagaatcgcttgaacccaggaggtggaggttgtggtgagccgagttcatgccactgcactctagcctggcaacagagcgagactccatctcaaaaaaaaaaagacctacacctgtaaaggtttggtgtagattcaaagagtatccacaggtatctgaaacagctattaaaatactgtatgaggctggcttttcttcatatacttcactcagtcaacatatcaaaacggattgaatacagaagcagatatgagaatccggctgtcttctgtaaatcctaagtgacagttccattgtcataaaagaggacacatagaataatttttccagaaactccaaggtcaaaatctatattttaaatgtgcctaatgtacttctaaagtaagagttcttactttgattagttaaatcagaaaaaatttttattcatattcaaaatagtataaatatataaaaatgttaaaggcatagccaattattgatcacagaagtgacatgatacagtcgtttgttacaaatctgagtgattatttacaaatctttagagttgttgtctgataggactcagtacggcagttggagtgtagctgaaagtaggataaagcaggtggatatgtgcagatgatagaaatatggagatggtagaatcaataataaaaatatcacaaaacaagctccgtgatcctactttagctgttaaacttttgttgttgttgttgttactgagacggagtctcactctgtcgcccagctgttctcagctcactgcaaccttcacctctggggttcgagtgattctcctgcctcagcctcccaagtagctgggactacagggggggcaccaccacgtccagctaattttctgctaaactttttgaaatgagaggcccatggtaaagtagatatcaacataaggcttgttgagtgactgattaattctagattattattctcatttattggcacaaaaacaattacacattgctttctatttggctcctctggtgcccttaccaccactgcacagttcctacatatgccgtgattcttaacctttggagcttgagtaattacccctaaatccctctcttaaaaatcttgggggccaggcacagtggctcacacctataatcccagcactttgggaggccgaggaaggtggatcacctgaggtcgggagttcgagacaggcctgaccaacatggagaaacctcgtctctactgaaaatacaaaattagccaggcttggtggtgcatgcctataatcccagctactcaggaggctgaggcaagagaattgcttaaacccgggaggcggaggttgcgggttcaagcaacctcaagcctgggcaacaagagcgaaactctgtctcaaaaaaagagaaaagaaagttccttggccttttcttgtgtttcttgaccttgacattttttgaggagtccaggccagttattttgtagaatgtgtcagtttgggtttgtgcgatgtttccttgggattagattcaggttgtgcatttttggcagaaatacaactatagtgatgttgtcaccttcaccatgcatcgaatcaaagggacatgatggcgatggcttccaaggtgatgttctctttgagcacttggtaaggtggtgtctgcttaatttctcgacaggcaagttactgtttttcctttgttattgataagcaacttctgggggatacttggagactacgcatatatcctgttctttatcatgctttcacccaatagtacccactgatgaacatattgtgtatacatgaaataataataaactattatcactgatagaaggaacatattgtgtatacatgtaataataatgaactattatgacttcttaaagcaggttgttcattgtttcctgagtataaataaatcagaaatgaatggctttaattttctgtaaaatatgtttacttagaaaataatagaaaatgtcctttacaaaatgagttctagggttttattgaacaaaatgtgtttgcaaaacactgtggggtgaaaagagtatgaccccttacttccccatcataacgctcctggctgacactcccgtaataaaagacaggttaacaagagaaaagcataacatatttatttgatcaaagtttttttttacgtgacaaaggaaccttcagaaatgaagccccagaggtccccagaaaactgtctgtttttatgcttaggctgggtgattaggggacatctttgtagaaatgtgagtgaacaaaaggggaagctctaatgctaacagactgagtgcagacacccagcaaggcctgtctgttcagattcttctcagcctctccctgcagcatgcagcatcccttcctcctgggtatggggcagggcccttctggaatgcgggtttatgacctccgtgcaggcaaaatagaccagatagtttctttatggccaactcttacacagaaaggcaggggaagattggagtaatttttttttaggttttaaggctagctttcagggagaatggttctggtttctatggacttgccttggggaagagggattttagtttccttgtttgtttgtttgtgttttgagatggagtctcactctgttgcccaggctggagtgcagtggcacaatctcagctcactccaacttctgcctcccaggcttaagtggatcttctgcctcaacctcccgaataactgggattacaggcatgcgccaccacagccggctaatttttgtatttttagtagataccaggttttgccatgttggacaggctggtctcgaactcctgacctcagatgatccacccgcctcggcttcccacagtgttgggattacagacatgagccaccgcacccggccctagtttcctagtttctatggtcggccttgggggagaaagtttagcaggaggaggaaggcgaggagaaggtcagaaactttgcttctgaggccctccaaggccctcccaggccctttgctccaagtcctcagcaagccagaggacgtcttctgagcccaacaacagtttaaggcattccaaaattagaagagcaatcaggcacccaaccatactaaaagcgtgtttatattttcgcatattttccaatccattgaacaaacaagcaaacaaacaaaagaactggtgtgtagagtgaaaggagcgttagtgtgtataatatctgtggacagaatagtcgtctgaactgaatctacagcaaaactacaaagctgtgatattgtgactccgagaaagtgcagatttcatattccagtaagatttattgaatgcccgttgcctgctaagcatttcatacataagcatattcacacacagcaccttattttgttatcataactctatagggcaatggtattatgctattcttccactcaagagaacttttcagaggttcatttacttaacaaatcataactgccacatcccaggtgctttgttaagctctgggaatgcaacctggaagaagacagatctggttcctctcactttctaagcccagttataacatgctgggcccatgattttactcaacagtaaaatcgaggtttacgctgtgtgctaagagaggcatccaaaccaaacgtgtggactcaggggaggctttgctgatggaacttctaattaggctgggaaatgaaagacgacaggaagctgggtgaggaggggggatggtggtggagggaggacccaaatattccaggcagagggaacgttgtctcaaaaaaataaaaatagaaataaaaaaggcttctgttgggcacgatggttcaagcctgtaatcccggcactttgagagggtgacgtgggcggatcaggaagtcaggatatcgagaccatcctggccaacatggcaaaaccccccatctctactaaaactacgtggtggcacatgcctgcaatcccagttacttgggaggctgaggcaggagaatcgcttgaacccaggaggcagagtttgcagtgagccgagatcacgccactgcactccagcctggtgacagagcaagactccatctcaaaaaaaaaaaaagaaaaagaaaaagcgcctcaggctgtcccagcattttcattcaaaaaggagctttgagagacagccaggtggctagtgacgggctagcagaggcagagagggctgcaccttttctaccacagtttaacattgctcagagattgcgtgtctaacctcaggaaggttttgacatagtttacactgattttactttgttcacttcaggatggaaaggatggcagagtctctgctgcatccaggatagtatgaatcattaaaatgctgaaaccactttcagcagtgtattctagtcctggccggaagtcactaacctagctgaaacatcaaatattatggtaatttggtctgagaataaataatagattatgttaatacagacagggatgagataatgagaaacaggctacttaagaagcatattgagtggtttatttgtgaatcaaaaagaagcaaggaaattgcattaaaagaaaaactgaccctggagtcactcttttaggtgaccttaatattccataaattataagttaagataaatgaaacaaaagctctatattatgaagagtgaaattattttgtaattctgacagaaaactaagtattctaacattttactgaagaaaagcctgttgatcattctcatttcccgccacagaacacgtataccctttgccaacacttactgagcagttactatgtgcggttactaaggtctaatgttttgttttgtttttttttgagacagggtctcactctgttgcccagactagagtgcagtggcgtgacctccgctcactacagcctcaacctcccaggcttaaacaatcctcctgcctctgcctcccaagtagctgggaccgcaggcacgccatcacacctggctaatttttctacctgtttagcaacagggcctcactatgttacctaggctggtcttggactcctaggctcaagcgatccacctgcctcagcctccccaagtgcagggattacaggtgtgagccaccatgcccagcctaactctttacatccacgcatatactaccttaaacatctttgccatgcgagaatgtagataccacttgtatagattgggaaactgaggcacatgatggttgaataatttgccagaggaaacagagctggcaggctgaagggcttcagaccaaaacttctctgacctcatttggtagcaaaacatatgcaaagctttctacaatctttacataccccattaagtatgaatacttatacattctcctgcagaaatatgtataatcataatatactgccccaaatccctcttaggagaactgatagatggtgtgtggattgtctcctgtctctaaaaaacactctgaggccaggtgcgggggctcacgcctgtaatcccagcactttgggaggccaaggagggcggatcacgaggtcaagagatggagaccagcctggccaacatggtgaaaccctgtctccactaaaaatacaaaagttagctgggcgtggtgacacacacctgtagtcccacctactcaagtgaggcaggagaatcacttgaacctgggaggcagaggttgcagtgagctgagattgcaccactgcactccagcctgagcaatacagcaagactccgtctcaaacaaaacaaaacagaaaaacactgtgaattctaaatatctgacctcaggggttttggaaaaggcattttggtcctttgcaatttatacaccaacaaataatgaattaatatagtaacataataatttatttagtataccctttaaatttaatacttgcattttccagatatcaatataaagaaattggcaaacctcaaataaaattcaattggcgtgttttagagacagttatgctgctcttgtgggccgctgcctgaaatccaggtggctgcctgctggtagtctggagtgtagtgtctccagaatgtaaagcactgaacaaagcaaggacatcatgagacatcctgtttgaatattttgtctgcaatttagtgaactgtgtgatcctcagcaaattaccaggtgactctgtaacactgtgataacagtttatgtgtccaggttattgtgactattgaataagatgatgtgggtctttacacctggcctcttcatgggcatgtcgtaaattgtagcaattattaagctagataattatacatagggataatacttttctatcaaagcaaataataggcactagctaaatgtctccatgaaagctaagtatgataaaatacacaggaagcatctccaacatgaaaagtacccttagtgctttgtaagataacagttcccacagtcatagagcttaccttttggaaaggcggaagttgaaaaatgacttttttttttttttcagacgaagcttcgctcttgtcccccagactggagtgtgattttgcaatctcagctcactgcaacctccgcctcctgggttcgagcgattctcttgcctcagcctcccgagtagctgagattacaggcacctgccaccacgcctggctaatttttttgtatttttagtagagatggggtttcaccatgttagccaggctggtctcgaactcctgacctcgtggtctgcctgcctcggcctctcaaagtgctgggattacaggcgtgagccactgtgcccggccgagaaatgattttattatgtagctttgaaatgagttcaaacacgtaatttgctacatgagtgacttaacgttttcctgtgataaaaacatggagtgtaatcttccccacgagaatgctgggtcacactttatcaggccacatatgtgttgctggcttcaacctctagaccccaaacacagaaaatgtgagattttgacaggcacattgagagttcaggctgtggcaagaatactgtctgccaaccttcaggcaagtctctgaagccgtacccaccaacactggcaccactggctggcatcaggggccttgtgtcatggtggatctatgctgcattgctgaaattcactctccaaagaacctctcctagaaagggacacctcctagaaagagacacctcacacttgcattcaactgtacggctacagaggccttctgccatcctaactgaccaactagactttaataaaattagaactcacttactctgtggttaatggacctccctcctccatggagtggattccctgtgagagctgttctcattattctcccccttttgagcactgaaataaacaacaacaaaagctacaaaaaaaaacctctttacatggcaataaactgtgattcatgaaattatactttgttcatctcatttcaatcataaaaaacactttaaaaagcaagtttagccgggcgcagtggctcacacctgtaatcccagcactgcactttgggaggccgaagcaggtggatcacctgaggtcaagagttcgagaccagcctgagcaaggcggtgaaacactgtctctactaaaactacaaacttagctgggcatggtggcgggtgcctgtaatcccagctacacgggaagctgaggcagcagactcgcttgaacccgggaggcagaggttgcagtcagcagagattgtaccattgcactgcagcccgggtgacaagagtgaaactccatctcaaaacaaacaaacaaacaaacaaataaataaaaaataaaacgcaagtttaaatgaatatgagaagatggtaagtgctatgcagagaaaaagaaaaagcagaactggcttggaataggtgttgagggagcgggcagcatgagtgacaaaggtgacaggtggtaaatataggcctcaatacaaaagtgaagtcggatctgagactggaaggaagtgaggacctagtgagtatcagtagaaagtgttccaggcaaggactgtccagggcaaaggccctaaggcaagaattgccggctatgttgattcaccatcaaaagcatgcccagagccctgagccaggtgggggaattgggggagatagtagagtagatgggttcagagacctgggagtgtggagatccagagaaccacacaagacagtaccggcacttctgacagtttctttgttatgtacctgtgcttccatttgaaatcgtccggcccaggggtcagcaaactttttctataaagggccagatcatgagtatttttttttttttgagacggagttttgctcttgttgcccaggctggagtgcaatgacgggatctcggctcaccgcaacctccaactcccggattcaagccattctcctgcctcagcctctggaatagctgggattacaggcatgcgccaccatgcctggctaattttgtatttttagtagagacaggatttattcatgttggtctggctggtctcgaactcaggacctcaggtgatccacctgcctcggcctcccaaagtgctgggattacaggcatgagccactgcgctcggcgatcatgagtatttttaaacgttatggttcatatgatctctgttgcagctactgaactcagctactatagtgtgaaagccataggcagttatgtaagtgaatgagcatgattctgtttcaggaaaactttatttacaaaaacaggcacggggccatgctttatctgccagccatagtttaccgacccctgctttggcctaacttataaacacaaggaatttttctctctgttttcttctagacattttataatcgtatttattccttttttatatatgaagagatttattctgagccaaaacatgagtggccagttgcccatgtcacagccctcgggagatcctaaggacatgggcccctattttttcatttgggtctgtggttcattttgaggttatttgtgtgagtgttagctaatgcttgagtttatatagaaaatatgtcttatttatatttaacatatttctggcctatggatatctaattgttcagcactatttgttgaatgattatgttttccctttaccttgacacttcagtcaaaaatcaattgagtggggcacagtggctcacatctgtaatcccagcactttgagagaccaaggcagacggatcacttgaggtcaggagttcgagaccggcctggtcaacatggtgaaaccctgtctctactaaaaatacaaaaactagccaggcgtggtggcacgcacctgtagtcctagctgctcaggaggctgaggcaggagaatcgcttgaatctgggaagcagaggttccactgaggttgcaggttgcactccagcctgggcgacagagtctccaaaaaacaaaaaagtcaactaaacgtgtgcacctgtgtgtgtgcgcacctgtgtgtttgcgcacctgtgtgtgtgtgcctgtgtgtgtgtgtgcgcacctgtgtgtgtgcctgtgtgcgcgcctgtgtgtgtgcctgtgtgtgtgcctgtgtgtgcgcctgcatgtgtgtgcacctgtgtgtgtgcctgtgtgtgtgcacctgtgtgtgcatgcctgtgtgtacgtgtgcacctgtatgtgtgtgcctgtgtgtacccgcctgtgtgcgtgtgcacctatgtgtgtgcgcctgtgtgtgtgcgcacctgtgtatgtgtgcctgtgtgtgcacctgtgtatgtgcccgtgtgtgcctgtgtgtgtacacctttgtgtgtgcctctgtgtgtgtttacgtgtgtgcgcctgtgtgtgtgcatgtctgtgcctgtgtgtgcctgtgtgtgtgcctgtgtgtgtgtgcgcctttgtgtgtgcctctatgtgtgtttacgtgtgtgtgtgcctgtgtgtgcgcctgtgtgtgtgcgcctttgtgtgtgcctctgtgtgtgtttacgtgtgtgtgtgcgcctgtgtgtgtgtgcatgtgtgtgtatttgtctctctattttggactctctattttgctctattgatttctatgttgattcttacacaaatacaacactgtcttgattactgtatctttatggtaagtctttttttttttcggagtctcacactgtcgcctgggctggagtgcaatggcacgatctcggctcaccgcaacctccgtctcccaggttcaagcgattctcctgcctcagccacccaagtagctgggattacaggcgcccaccaccacgcccagctaattttttgtatttttactggagatgggatttcactatgttggccaggctggtctcaaactcctgaccgcgtgatccacctgcctcggcctcccaaagtactgggattaaaggcatgagccaccttgcccagcctatggtaaatcttgacattaggtaatctaagtcttttaactttgttcttatttaaaattgttttggctattctgtgtcccttcatttacatatatgttttaggggcagcttaccaatttctacaaaaaaacactgttgggatattgatgtggattatattgaatctatagatcaatttgagaagggtttagttcttaacaaggatctattagataggataacaaatgtacaaaccataaaagaaaaaaatgatgaattgcacttcaccataattaaaaaggcacaactccaaaatggcaaaccataatctggaagaaaatatatgcaaaacataaatctaataaaggacttgtatccaaaatacataaagcgcttttataactcaataataaaaaaaatcaacctaattaaaaactgggcaaaggatttgaatagacaattcacaaatgaatatatataaatggcaaacaagtacatataaaagcatactcaacatcattagttattgggaaaatgcaaattaaaattacagcgagataccactacgtagccactacaatggctgaattttaagcggctgacaatgccaagctttgtcaagagtatgagacaactggaactctcacaaattgctagagggaatgcaaaatgaaaagtatgcagtttcttaaaaagtttaccctctcctcctgtatggcccagcaaacctgctgctaggtactcaaccaactgaaatgaaaacatgttcacacaaagacatgccctgtgatgttcattgcagctttattccaaattgccaagaactggaaacaacccaaatgtccatcagctggcgaatggataaacacattaccctatgtacatacaatgcaatactcctgagccctcaaaaggaataattcactactacatataacaacctaaacaaatctcacatgcatttgctaagtgaatgaagccatacacaaaagggcacatactatgtgattccatttaaataaaaatggattgcagaaaagcaagcctacagttagagaaagcagatcagtggctgccagagaccatgaaagtggtggttgtgacaggaggattaactaggaagggcatgaggagagttggagggagatggaagatggacctgttctacactgtgacttattgttaaatgatgcttacatgtgtggaagccgttgaatcacaataagcaggcaagctttgatggaggcttgaaccagggtgatagggaaagggaactcacaatgagtcatagacacaaatgttaaaataaaactagtaaacatctagaaaaaaaaaacgaaagaaaaggctgggtgcggtggctcatgcctgtaataccaacattttgggaggccaaggtgggcagatcacttgaggtcaggagtgcgagaccagcctggccaacatggtgaaaccccatctctactaaaaatacaaaaattagccgagcctggttgcgcacacctgtaatcccagctactcaggaggctgaggcaggagaatctcttgaacctgagaggcaggggttgcagtgagccccactgcactccagcctgggtgacaagagcgacactctgtctcaaaaaaaaaagaaaaaagaaatcagaaagaaaaaaacctttctgtttataagttaggccaaagcaggggattggcaaactacatccagcaggtgaaacgtggcctccgccctgtttttcctaaataaagttttaccgaaacactggccttgcttactcacttgcataatgcctatggctttcttgctgcaggactgagctgagcaggtgaaaagggctcagattctctgttttgaaggtagagtcacaggatctgaaggctcgggtgtagaacatgagttttgaggatgatgtgccaccctcctcgcttcctgcggaaaggacggccgtggctgagcgcggtgggtgcgggccttgatcccggactgcggtgtgttgtcaggtttctccaccgtaagatcctttttccacaccgcgctcctgggaagaaagtcagaaagtgcagcccttccttaggcaagcgggagtttcgctccggctctatccaccctgtttttaaaactgaacatcgtacacattcgaaaacaactacaaattctctttcattagctaattttattttattggttcctcttgaagttagatgatgttatacattcatgatcccagcccagagctcctgattcagcctagccagggtgaaacccaccggattaacaaatgcctcgtgtgattcagatgcaaatagcccatcagcccacttcagaaagctcctctctaatcacttactaatgataattactctgaactaggacctctttacggaggctgaagctgtttttctcttggttaaggtattgtcattagtttcctgtcagagtcggggtcacctctctgcccttgtcggcctgcccaacagtcacacaagttgaacgaattcggcaaccacctcattactattcattgcccatgcggatattcaaacgcagcacacagctctatcgcggctccactccacgaaaagtcccaagtatatacaaataattgtataaagtactaaaaatgcactttaaatgagttccacatctccaagacacagacaaaccaaggctattgtcaagagtccttctagaaatgtgccttcaaaagacacaaaaggaaacaacgggagacattcaacgaggacagtggtttcctccgacgaggggaatggaaagcctggcgctgggagagctgcgctcttgaccctcctttccctctaactcgcccagccatctagggaaatgcacttcgtttttgcgcttcaacctcttatctgtaaaacattaataataggccgggcgcgggggctcacgcctgtaatcccagcagtttgggaggccgaggcgggtggattgcctgaggtcaggagttcgagaccagtctggtcaacatggtgaaaccccgtctctactacaaatacaaaaattagccgggcatggtggtgcgcgcctgtaatcccagctactggggaggctgaggcaggagaatcgcttgaacccaggaggcggaggttgcagtgagccgagatcgcggcaccgcactccagcctgagccacagagtgaaactcagtctcaaaaaaaaataataataatagcacctgcctggttttactttgcgtagatttaggataaaattagacactgcgtgcatctgagaaatacagttgtcacacagatgtgaagttttctgttttttgtttttttctaaagcagtcttgtttcaataaaaccttatttacaacaacggattttctttatttctttacaaatactcatgggatcaaataattcaatttttaatttttaatatcatcatgattctatgcccagatctaggttaaggaaacaaagttgaagaaacaaattgcctctgatgtcccagcagataatgaagtagatcaagatatacgacacacaaaattatacacaaaacctgtagattctaggagtattcctatcaagttctatttagttgcttaaaataattaccttagcattctaaaaatctgtaaacaatatggcatttctgaatatttaacattggccttttcaaaatgaagttcaattaccatttcccctgagaagctgtaagcctgagagggtctcgtctcctgacactacggttttcaatcctggctcggccgcttactggctggtgattgtgggtgagtttctatgctcttcagttttctcatcagtaaaataaagataagaacagcaccaactttgtgggttatctgtgagtagttagtgtccacatgtgcagaagtctttagaacagtgctatatgtgtttaatattgttatttttattactatcggttttaagggattaagcagctgttgaaaccaatgagactacttttttttctttttctttttcttttctttttcttttctttttctttctttcttttttttttttttttttttttttttttgtttgagacggagtttcgctcttgttgcccaggctggagtgcaatggcgcgatctcagctcaccgcaacctccgcctcccgggttcaagccattctcctgcctcagcctcccgagtagctgggattacaggcgtgcaccaccaagcccggctaattttgtatttttaggagagacggggtgtctccacgttgaagctggtctcgaactcctgacctcaggtgatccgcccacctcggcctcccaaagtgctgggattacaggtgtgagccaccgcgcccggcaagactactctttaatacacgcacacacacacaaacacaaaacctggaaaaatgtgctcaaatagtttgttagtactttatataacaactgaaaattctttggatttaatcaaaatggcatatttgaagtaaaaacacctatacctactctctcaagcctcttaggtagaaaatatttgatagaaaggaaattaattggattaccaaaggacagtaggtgaccccaattacttttgcttttaattataaaaaaagtctgagccataaaattggaaaactcttcctgtaatgaaaaatgtagagaagtagtttcacaattttacattttcttttttttttttttcttttgagatggaatctcacgctgtagcccagactggagtgcattggggcgatcttggctcactacaaactccaactcctggagttcaagcgattttcctgcctcagcctcccaaatagctgggactacaggcacctgccaccatgcccggctgattttttacttatttatttatttatttttatttttaatagaggtggggtttcaacatgttggccaggctggtctcaaactcctgacctcaggtaatctgcccgcctcagccttcctaagtgctgggactacaggagtgagccattgcgcccagcacaattttttttttttttagactgagtctcactctgtcgtccaggctggagtgcagtggcaagatcgtggctcattgcagcctgcatctcccgggttcaagcgattctcctgcctcagtctcccgagcagctgggattacaggcacgcaccaccatgcccggctttttgtgtttttagtagagatggggtttcaccatgttggccaggctggtctcaaactcctgacctcagatgatccacccgcctcggcctcccaaagtggttggattatcggtgtgagccaccgagtctggcacaattttacattttctctttaactgacacaaaaggtcttcctcttatgtgacagtatattacgatggtatgatataccatcctattgactaatatttaaaattgcaaatcacttatcgaaatccagatttttaaagattaggtttaaatctgaatgcttcacaaagatcacttggctgccccggaagagctgagttccccccgcgctcagaggccgaagaggtctttgcgattatgggagctttcttaccactgtgggcacagagtctcatggcacctacacaaagggcctgctcctgtatttttttgtggtttcccattccattcagcacagacaaagggacccgttgaaaggcacacaggtggattctcttaaaagacatttacggatattaaaattttaaagtttatctgagcaaaaagctattcataaattgggcagctccagacggcaagcagttgggctccaccaaggaggggagtcgaggggactacttttataagatgtttgtagaaagaggctggttaagcttaatttactattcacactgagcactgtttccgtttgctgacagaggaactcaagggattggggccagctcaacctaatggtctctcaattgattttttttttttttttttgagacggattctcgctctgtcgcccaggctggagtgcagtggcgcgatcttggctcactttccaggttttcttattgccctttttctttatttcggcaagagtgagggacatgcagccaacagtctccagtaattcttcactctggcttccttcagtagggacttgacattttgatgtaggtgtcttgatgctgttgtttttacatgtacattttccctcggaccaaaaaacaaacattaaatatttcctcaaaaaaaaaaagctttatttttccctgcttataaaaataaacagaggccaggtgcggtggctcatgcctgtaatcccaacactttgggaggccaaggctctgggaggatcacctggggtcaggagtttgcgaccagcctggccaacatggtgaaaccccatctctactaaaaatacaaaaattagccaggtgtggtggctcgcacctgtaatgccagctactggggaggctgaggtaggagggtcacttgaaccctggaggcggaggttgcagtgaaccgaaattgtgccactgttctctagcctgggtgacaagagcgaaactccatctgaaaaaaacaaaaacaaaaaaacccagaaatctctcaattaaaaatggatcctgaatttcatcttttaattttatatgtattctgaaatgctatcagaaacaactatgaataatggagatgagagatttcaaagaatttttacaaagaaggcaataatgatctagagcttgactctagctctgtgtaaaataaagcttgataagtagttgttatcggccgggcacggtggctcatgcctgtaatcccagcactttcggaggccacggctggcggatcatctgaggtcaagagttcaaggccggcctggccaacatggcgaaaacccatctctataaaaatacaaaaattagccgggtgtggtggcaggcacctgtaatcccaggtactcgggaggctgaggcaagagaatcgcttgaacccgggaggcagaggttgcagtgagccaagattgcgccattgcactccagcctgggcgacagagctagattctgtctcaaaaaaaaaaaaaagaattcattatctccaacatgtttactatagctggggagcaaagtgaacataaattgagtataaaaggtaattcataatgaagagctaaattgtgttgtgaagactgaggatgttacagttcaaagcactgagggctagagcagcaaagacggcttcgtttgtagtgaagtgccttcaaccactcctcaccccagttgcctgcttcgtaggcatacctcttcaggaaaatcactaatttatactctccaagaatacatgagtgtgctacaaagaaaaaaaattaatggtaaaaatatttatagaaaaaatcgtttgaagtgaattattatacattttttagatgtgatgatggcattgtgatcatgtttccgaattttccttatctattagataaataaaatagttcttcatgatatgaaatgtcgaaaattttcttcaaaatactccaaaaataagtttcctggcacaacttttaactttgccaagcgcaatgactcatgcctgtaatctcagcactttgggaggccgaggcgggccaattacttgagcccagaagtttgagatgagcctgggcaacatagtgagagactgtttttacaaaagtaaaaaatatatttaaaaaaataaaatactaggtggatgtggtggcgcatgcctgtagtctcagctactcaggaggcgaaggtgggaagattgcttgagcccagaaggtcgaggctgcaataagccctccagcctgggtgacacagcaagaccctgtctcaaaaaaaaaaaaaaaaaaaaaaaagaaaaaaaaaaaaagaaaaaaagtaaaaagaaaagataagcttaacaaaaaagaaaagaaacttttaacctttaggttgattaaatttctacgagattttctgatttttctcatgggctaatagtcatgagaggttagaggtttatgataagaattttttttttttttgagactgagtctcactctgtagccaggctggagtgcagtggcgtgatctcagctcactgcaacctccgcctcccaggttcaagcgattctcctacctcagcctcctgagtagctgggactacaggcacccaccaccacgcccggctaaatttttgtatttttagtagagatgggtttttgccatgttggccaggctggtctcaaactcctgacctcaggtgatctgctcgcgttggcctcccaaagtgctgggattaatactatcaaattgcctttttgttttgctaatatttaatactcatgataaaaagattttagactgtagcaggtttttctttttaaccctggttatattatttggcatgattcagatgttgaagtagcctcaattttaaaattctgccaggcgtgaaaaggcatccgccctctagcttactttacctggccactgcttgtatagcttacgaggtttaatcttgtcatttctggttgagagaagcagattttcacccacatgtagggttttagctatgtttgttttttctaaacagagccaactgttaattaatttctaagagtaggtaatacatgcatgcacccattacaaaagtagaaaaacaaaatgatttacaatgcaaagcaaatctccctctcataccaagcccccagctacccaggctccagcctgctcacttaactttggtcaattgagatcagtttacactccttcattgtttcataacctcttggaaagttctcgtaacaggaaaatgtggctgcattttcaattctgacctgtttctctaaatagatcacattctctaatctttctatgacttttctttctttcttttttttttttgagacagagtctcgctctgttgccaggctggagagcagtgacacgatctcagttcactgcaacctccgcctcctgggttcaagcgactctcctgcctcagcctcatgagtcactgggattacaggcacgtgccaccatgcccggctaattttttgtatttttagtagagacagggtttcaccatgttggccaggatggtcttgatcgctggacctcctgatttgcccacctcagcctcccaaagtgctgggattacaggcgtgagccaccgcatccagccaacttttcttaatttaagatggacttctatctcactgtgtaagtaaagctcaaggcatcatttattcttttaatattcacttcctctcacttctacaggatgtaaactgtctcaactctttttcttcgtttgtaagctgtgatcgtttcttaatttgttttattatttttattgccttctctgttttcctaaaatagtttctaaattttaaatgaacttttaattttagaaaagttttagatttacagcaaagatgaaaagataacacaccctcactcccaatttcctgcattgttaacgttgtacattatgatggtatatttgttacaactcaagaccaacactgacgtattattattgactaaaccccacactttatttcattttactagtcttcccttctatcctttttctgttccaggaggccatcaggatcccacattacatttagatatgtgtctccttacattcctctagtttatgacaatttctcagacttcccattttgataaccctggcagtttcaggagtactggccaggcccctatacaaagttcttccatcttggtttgatgtttttatgaatagactgaggttatgggtgattggggagaatatcacaacactgaagtagcattctttttttttttttttgagacggagtctcgctctgtcgccaggctggagtgcaatggcgccacctcagctcactgtaacctccacctcctgggttcaagtgattctcctgcctcagcctctggagtagctgtggaccaccacgcccagctagtttttgtatttttagtagagatggggtatcactatgttggccaggctggtctcgaactcctgaccttgtgatccgcctgcctcggcctcccaaagtgctgggattacaggcatgagccaccgcgcccggcctgaatatgatatgattcttaccatatcatatccgggtgcatgccatcaacctgactcttccctgatgcaattaacaccttgactgcctggctgaggactgcttgtcaggcttccccctgaaaaattaccactcctccacctcttttccatagtcttgaaacaagctgctggcatcacctacacttagggtagagaggaattcagctccacctcatcgaggggggaaatatttacatacattatttggaattccctatgggagatttgtctcttcttcactattcatatgctagattttctgtgtattacagggttctttttatacagcaattaccaaaaaaaaaaaaaaaaaaaaaaacctgcctactgcctacatataaacatttttatctgagatatttccattatacctctaaatgaagaaagtaaatgctaacagttgttaactgataatttgttcaacaaatatgcattaggtttggcgagatggtttatgtctgtaaccccagcactttgggaggcttaggtgggaggactgcttgagctcaggagtctgagaccagtctgggcaacatagaaagatccctgtctctacagagaaatttgtaggctgggcgccgtggtttacgcctgtaatcccagcactttgggaggtcgaggcaggcggatcacttgaggtcaggaatttgagaccagcctggccaacatggcgaaaccccgtctctatttaaaaaaaaaaaaaaagtagaaaaattagctgggcgtggtggcgggctcctgtaatcccagctactcgagaggctgagacaggagaatcacttgaactcgggaggcagaggtttcagtgagccaagatcgtgccactgcactccagcctgggtgacaagagcgagactccttctcaaaacaaaacaaacaaacaaacaaacaaacaaaaaagaaggaaatttgtaaaaaaaaaaaaaaattagccaggcgtggtgtcatgcacctgtagtcctagctaccaagggggctgaggcagggggatcacttaagcccaggaattcaaatctacagtgagtcactatcctgctactgcactccagcctgggtgacagaacaagaccccacctctatacatgctaccctggcaggcacttgataaacacagtgctgctgatgaggctcacgggctaatagacaatcacaatgcggtatgattggtgacctctggaatatatgtatacatgcaaaggagcctacaggacttccacacagagggcttagggtcagcaaacatctcagaaggacgggcattcggctgggcgcggtggctcacccttgtaatcccagcacttcgggaggccgaggcgggtggaacactaggtcaggagttagagaccagcctggccgacacaatgaaactccgtctctaccaaaaatacaaaaaattagcctggggtggtggcgggcgcctgtaatcccagctactggggaggctgaggcaggacaatcgcttgaacccgggaggcagaggttgtggtgagctgagattgcgccactgcactccagcctgggcgacaagagccaaactccatctcataaaaaaaagggacaggcatggggcatgccaggcaggcaattttagactgtacttgtgtagatctttacttgacgttgcagaaatgtcaactgtttatatatgtatttttaatggtagtgtatgtgatacagaagtgctgggtagagaagagcatggtccctttaaataattcggaagtggggaagggatgtgccgggtaaaggagggcgtggtccttagctagggctccgcccccacggacctaggtgaggacaggcatctctgcccaaatgttgcatttcccgcccaaatgttgcatttcccaaaaccaccctggcctgccatggccgcatcctgggcctataaaaacccaagatgctagcaaggcagtgacagaggccgccagacgttgagaggacaagtcagcagaagacgccacagccgctggcggtggagaggaggtcgagaggctcacgcgcgcagaagaaaataccggcacacggacaggccattgaccggcaggaccaggcggagtttggcccgggcagtgggaggagagccaggggaagatcatcttccttctggctccccatcgtgggagagttaacacttgacactcgttctccaagcccaggtgtgctgcgattcttcaggtacaccaaggcaagaacccgggatacagaaatccctctctccttgcgataaggaagggggcctattgagctggttaacatgagccgcctatagacaccttgtaacagacgccccctgggtcttcaggagccgtaaacatccaccgcagacaccgccgtggggtcggagccgcacaaagctcccctggaggtttgagcagcgggaagcgagccagagccacaccccaactgcacaccctgcgggggcctttcagatgggaagagagtaagtctcctcctggtactgtaactttgaggtttggtgattttttttttttttaaacagtctttgaagactgatataaatggtttggccagtgccactaccaggtgctgtctggttttagatgaataactttaattccctgagcttaacttttcatattttcttagtgttttgtgaatattcaagctaagtcagcagtagcgacttagtgcatgactttttgccacccctaatgcatgtccctttgcaatgtgatggttatcttctcccatcaataggtgaagtccattttctcctcctttgagtctgggcttgactgactaacacggcttttgctaatgggaaattaacaaacatgataaagaggcttaagaagaactgacgttggggttttgcttcctgctgctcctgggaccctgctgtcatgtgaacacatcggattatcttgtcggagaatgagaccaggggaagagaaccaacctaccctggccgatagaaagccactcccagggccggacacggtggctcacgcctgtaatcccagcactttgagaggccaaggttggtggatcacttgaggccaggagttcgagaccagcctggccaacatgatgaaagcccgtgtctactaaaaacacaaaaattagctgggcgtggcgggcgcctgtgatctcagctactccggaggctgaggcaggagaagtgcatgaacccgggaggtggagtttgcagtcagccaagattatgtgctccccagcctgggcaacagaatgagactgcgtctcaaaaaaaaaaaaaaaaaagcaaagaaaaaaaagaaagccactcccagagggtaagtggggccatctggatatactagccctcaccagtccactgactgatcaccagaatttgcaaatgaagacaaatgcatgagtgagcctcaccaaaaatagcaagcaaagtgtcctgcctcgctccagtgatgatctatagaatcatgagttgacaattgttgtgttaggacactaaggtttggaatggttcatgacacagcagtagattaccaataccagtcaaatggtgatgagaacagagtaactgttgcaagtttcagaagtaatgctgtgtttttgtttttctttgagaggtttgagtgctgtgctcacctaagtttaaaatgaaaatggggctgggcatggtggctcacgcctttaatcccagcactttgggaggccaaggcacgcggatcactagaagctaggagttcaagacctgcctggccaacatagtgaaacctcgttctctactaaaaatacaaaagttggcggggagtggtgactcatgcctgtaatcccagcacttggggaggccgaggcgggcagatcacgaggttaggagttggagaccagcctggccaacacagtgaaaccccgtctccactaaaaatacaaaaattagctgagcttggtggtatgcgcctgcaaccccagctactcggaaggctgaggcaggaggatcgcttgaactcgggaggcggaggttgcagtgagccgagattgtgccacagcgctccagcctgggcaaaagagctagactccgtctcaagaaaaaaaaaaaaaaaagttagccaggcatggtggcacacacccataatcccagctactccagaggctgaggcacgggaatcacttgaatctgggggcggagcttgcaatgagccaagagcgtgccactgcactacagcctgggcaacagagtgagattctgtctaaaaactaactaactaaataaataaataaatgagaatggtatttgcatatagccactagctggtccccaaaagcctcttccctggccaactggtctcctgcagaaccctgactagtgacaattcctccatggaacctctttttctattattaaacaattatataagtgcatattctgggtaggaagtgctttcacactctaaaaaccctcttctgtgatgaaatctggttgttttcctttaaagatgaaatatatttctactgaccccaatgtggagatcaagtgattctcaccttgaaagtatcatggttggtcactgtgattagaacaagaaaatgctgtgatttttctctgcaacagtagggccgacttgtcctgaaagccgaaagtctttgcagcgaaaggaaagggtgcagtggatgactcctagccctgagaataacatggatctggaaggtccatatatcattcagtgaatcagtaaacaccactgggttccctttggggatatagcaccaacaataaagggccctgttctgaattctctggaattaaactgagtgttcaggatgcaaaactcattaaaaattggcagttgcggcatggcatggcataataataaatccaggagcagaagggatgcgaacccatatatcaaatgaggtcccaaacgctccccagtgtgtgactcctgctagttctagtgtggctgccattgcatgggacgtgttggagtccttcatgggcgctccatgaaagacatctttctgtgctacaggcagccctggtgggatgtgctcccaccacaatgaaaaagtcagccctagaaagatcagtggcagaggaaagaagtgggtattttgctttgtttttttcccaaaacagaaagacgtaattgctattcccactctggtaagcttggcatataaataccagggactctggtcttcctggcaacccctctctccattggtactcagtcactccaagcatgttccatggcatgttaataagtgctgcttcaacaagccttaaagaacatagttccactcttcatgctaattgcctatgcacattctctcccacctttcaccatcacaaattcagaaacagccagcaactcctcacaagtgaatggtattaagctgttaggtcgtaagtaagaccaattgaatcaacaggttcataggactttaaacgtcacactgcttcagatgtctagatcatcagttactcccatcctgctgtgcctccatctccaggtttcttcacatgagcttactagcttaaatgagatttatttgaactaaaaaggtgaaggatgacagggcatggtggctcacgcctgtaatcccagcactttgggggccgaagtgggcggatcacctgaggtcaggagttcgggacctgcctgaccaaagtggagaaatcccgtctaccaaaaatacaaaaaaatgagccgggcgtggtggcgcatgcctataattccagctactcgggaggctgaggcaggagtatcgcttgaacccaggaggcagaggttgtggtgagccaagatcacaccactgcactgcagcctgggcaacaagagtgaaactctgtctcagaaaaaataaaaaaaagcagaaggatctccccacgctctcacaatggttagttactggttaaaattcattatgtgcctttagaaattaaagtgataagttggagacctaactagctctgaaagctaataagctacggcagagagggtgggaatctgagaggcagagagtaagagtaagtaaaggagagtaagagtaagaaaacacgtgtggggtccactctaccctgtgacggtgtcaataaactgtatgcaaaaggctagtactttttttctgaacttgtctaaatctacttttatttaaatagaaatccaaaacacttcctaggttatgattttcaagatcagtctaaaatttaaaagtaagcccctaaaaataatgtttgaattattagctatagaaaatatttcatggctgggcatatgtgtctcacgcctgtagtcccagcactttgggcggccaaagcgggcagatcacctgaggtgaggaagtcaagaccagcctggccaacatggtgaaaccctatcttactgaaaatacaaaaattatccgggcgtggtggcgtgcacctgtagtcccagctactcgggaggctgaggcaggagaatggcgtgaacccgggaggtggaggttgcagtgagccaagatggtgccactgcaatccagcctgggagacagagtaagactccatctccagaaaaaaaaagaaaatatttcatgcctatcaatcagaaaaaatacaataattattcaagcacacatgaaatcttaaaatcatgttcacgtgctagcatacgaggaaaaccttaatccattctgaagatcaatattataaagattgtggtctgctgataatacagtaaatttgaaaccattagtagatgattgatttaaaatgttatgcccgggacatttacaacatgcaattaaaaacttctgagcaagcttttgccagtgcctgctgccttttgtgattgtgcatcctagctgaggcatgcagaaccaaatgaaagcaaggattcattaactctttgaacttgttaaatgctaacagttaaccattagaaatggttcaacgatgtgagccacactacttcaactttttctttgttgtagttttagaatggtcaatttttagctacttgacagattaaaagcaaaataatcacgccatatttagtcctggagttcaagtctacatgtttatgtgaaaaatctttgtaataaacttttaacatgagaaggcaaccttaagctctattttagccaaatgaaacaaaacctgaaattgtattagaacatttccctgtcttcaaactggtgtaacagaatcctgatatgcagcttgatggatttcaccagttaaggcacattcttctccctccgtccctgcaatactgtgtatactgaacaatgtgcatttgtctgaggagttattttgtttgccaccacttaacgaatctcaaaattttgagtaactgtacctcagtctaatcggactttttatgagctttataactacattgaaacccttaattcccatttctgggtgtttgtgagcctgattgctgtcatttgcgactctaggtactcaccagctaaataaacatagtttttgtgtggccagcacgtactgctcctcaattcctttctccagcttccgcggcgtcctggcatccttaaaatatctacaaaatatggccttcattcataaatgaaatcagtttctatgtgagtgtgtggatgtttattgatcgcacatgtataagtggaaatacagcatatgtctgggtattcttttttcttttgagacagtcttgccctgttgcccaggctggagttcagtggtgcaatcttggctcactgcagcctccaccttccaggttctagtgattctcctgcctcagcctcctgagtggctgggattacaggcgtgtgtcaccatgtacagctaatttttgtattttcggtagagacaggttttcaccatgttggccaggccgggctcaaactcctgacctcaagtgatccgcccgcctttgcctcccaaagtgctgggattacaggcttgagccaccgtgcctggcctgtgtgggtatttgtatagtcttctttttaacatatttttttttcattaattacatatcaacattaatttcgtatcttgaaacaagttgattttgtataattaaaggtgccgagcatctataaaataaataaataaataaaaattaaaatcttctgagcaaaatgaggttcattttgaagaatgtagaataaatgacagcagcaccccatgttgatattggtagaacactgccaaagcagtatctagagggaagtaaagaactttaaatatatgaatgaagaaataagaaagattggcaacaaattaggtcaggatttgacccagaattcaccctttagctgttctgagatatagttcatacaagaaaagtaggataaatcctttacttttttatttaccagactttagaataattcattgataaaatactaacaattctctgatccctaggtagagtattatgcatgagttttcacttcatttatacttttatttctgaaattttttttaccaaacatattctaactttataatcagaaaaatacttttgaaaaaggagtcagggaataaagatatatttgcaacttagtaaagttcctctgatctcttgaagtattaaaacttttgaatacatgtgaaaaaaatttctaagacaactcatgaaatctgaaactgggatggtttctggaggttttcaaagaaagcgtctcatactaaagttaagacctctgttttatgtcattttaaaagagagcgcagctctcgtgctggggcattgcttcaacccgcacttggaggaatgagcatcacttcctgaatcaccagccttttctacagagcctcgattttctctagggtcttcccatccacacaccggcaatgctgacaatactcagagcttatgaaacctgacagatcacagtttgaggtgaaaaaactttaggaatgaaaactatcaagaggaattggaaatgaaaggtgaatgccattatatttattcaatttatagctaaattataatggaaaaaatctcgaaatagaaacattttttaaatctgaagactgtaattataacaatgagcattgtcataatgttgacctgtgtcacattacaaatattctttatcaataagacattaaatgtaataagttaatgaagaagttatgacttttgccaaaatgatagggcagtttttttattttgaattttaaaaaaattgtgcttcagtttgcaggatgtttgtgtgtgtgtgtgtgtgtgtgtgtgtgtgtgtggtgtaggggggtgttggtatgagatagaaattgactaacacagtccagcttctgttgattctttttctttcaaaaaaaagtcttcccataatatcttacactgctcgtctcagtagtttagtcaatgtttaacacatgccaaaatatttctgactctcagaataatttgattttagagaagtagatgggaccagccaggttcttaattttttccccacaactttttattttgagaatgttcaaacccactgaaaagctgcagatagtccagtgaataccctttgtgatgggctaaattgtgtccctacaaaattcgtatgttgcagtcctaaactgcgtatctcagaatgcggctgtgtttggagagaggatcttaaaagacgtgatgaagttaaggccattagggtgggccttaatccaatctgactgctgtctttgtaagaagaggaaattgggacacaccctgggacacccctgtgaagcagctgcaagagccaaggagaggggcctcagaggagaggaaggaccccgccgacagcctcagcttgggcttccagccttcaggactccgagaaaatggatctatgctggttaagccagccagtaagtggtattttattatgcgagcctgagcgaactaatataccttatacctttcttatacgttcactaattgttaacattgtgtcacatttttgtgatccctctctctgtctccacaaacacacatgcataggcatgcacacacactaacatgtgaagtatacacatacaacctatcacacacatcatacatatgcatacatatgtgtgtacatatgtatacgcatgtctaccacacttttggcaggggtgaaggaacaggtgaaccattacatgcctgttagttgcaggcaacatgacttttttttcctaaatacttttgtggaaacctcccaagagccagtacatttgcttataaaaccacactataagtttcatattcaggaactaaaaacagtactacattatacggtaatatgcggtcatatttaaatgttcccatttgtcctaatatagttaggtttgtttgtttgtttttctccaactcgaagtttaatcaaggcacacacactgcatttagctgccaagtgtgtttgcttttttttttttttagatggagtctcgctctgtcacccaggctggagtgcagtggtgcaatctcagctcaccgcagccttggcctcctgagatcaagtgatcttcccacctcagtctcctgagtagctatgagtataggcacgtgtcactgtgcccagctaattttttttttttttttgtagagacagggtctcactatgctgcccaggctggtcttgaattcctggcctcaagccatccttccacctcggcctccccaaaatgctgagattacaggcatgaaccaccttgcccagcctttattaagattttctattggtgcaaaagtaattgcagtttttgcaatttttttttttttttttttgagacggagtctcgctctgtccccaggctggagtgcagtggtgcgatctcagctcaccgcaaccttcctctccctggttcaagccattctgctgcctcagtctcccgagtagccgggattacaggcatgcaccaccacactcagctaattttttattttctgtagagatggggtttcaccacattggccaatatggtctcaatctcctgacctcgtgatctgcccacctgggcctcccaaagtgctgacattacaggcgtgagccacctcacccagccgcaattatttttaatgacaaaaaccgcaattccttttgcatcaacctaataatacattcttgtcattattcggatggtcaaatattcccagatttacaagcaggtgtgcttttaagctggtttgcctagcctgtgacatgtccctatgggttttcagcacatccttgcttaagccgataaacaatgaatagcaagtttttcattttgttctatctcttattttgaatctaaaagagcagcccctttttgtttcaaaatcttattgacatattgaagagattggtccggtttctataatgttctaccttctagatttgtccaagtgtttcctcatgatgtcatttagctttgcttatcacgtgtattttgtataatgtgaaagtgagagctaaaggtttcattagctgccaggtaagtagttttggccagatgttttataagttgtgctatactttatgattgcatcacattagcatgtaatatttagttgtcctactcttaaatttaatacttaccctaccattattgaacaaaatacacaaagcaacattaaaaaaagaaaaacaaaaatttaatacttaccctactattaaattgagctgtaatttcatcaccagtgtgtataataaaatgtcaccacattcacaaaactcatgtttttaattcaaatgagatattattgcctaatgactgtaagtgagactttagtgatttcagcaaatatatataatcgttttttgagaacacatccttaaatttcagaaaattgcagtaaaaatgaagtaccaacccattcttggtattacattctaaaactttggcatttttcctttgatcaccaattccacatctggagatactctccggacacttgtcaagttcatgattttactacaggagtctattcgagcaatatttgtaggcacaaaaatgcagaaacagtttcttcaagaaggggcttaataaacctaatgtggaacattggttatgtaactatcatgcagtcactaaagacgaggatctctgtataaggagacagactactatgcagaaattatttagtgaagaaggcaggttgcagaaccctgtatctagtgcaattccatgtatgtttgaaaagagcacagctgaacggaggaatgaatgaagaacatgtggaaacatacacaaaaattagaaaatgttagagaataactttgataaagttagataagattttcgttgtaaaaagcacctattttgaataaagattcattcaggttaaggcctcctttggaccccttacattcacgtggattacttttcaagatatattgcatgatgtctgtatgtctgacattcttcaatatttcaagaaaaagggttttgcaaaaaggccaatctatctaaccacaaatatgacttctaaattaaagacttaccaaaggctgggcgaggtggctcacgtctgtaatgccagcactttgagaggccaaggcaggtggatcacttggggtcaggaatttgagaccagtctggccaacatggtgaaaccccgtctctacggaaaaatacaaaaattagccgaatgtggtagcgggtgcctgtaatcccagctacttgggaggctgaggcaggaggatcacttgaacccaggagacgaaggttgcagtaagccaagattgtgccattgcactccagcctgagcaacagagcaaaactcagtcaaaacaaacaaacaacaaaaaaaaagaaaaaaaagaaaagaaagacaatcaccaaagatacctaattttggcctggcatggtggctcatgcctgtaatcccagcactttgggaggccaaggtgggcggatcacctgaagtcagaagttcaagactagcctggccaacatggtgaaaacccatctctaccaaaaatacaaagattagctggacgtggtgtcacgcgcctgtagtcccagctacttgggaggctgaggcaggagaattgcttgaacccaggaggtggaggttgcagtgagccaagattgcaccactgcactccaaccagggcaatagagtgagactgagtctcattaaaaaaaaataaaaaagatacccaatcttgttacagaaataccaaagtgcagaaatcagaaaactgcatagatcacaaaacttggataccacagaaacagtaatcacaacaataacaacaaaacaaatggaaggaagccaaaccttacaacaaaatgaaccgcacttccttagaggaatgatttgtgttaaataaccaccatcattcacaaaaataacaatcataaattagtagcacatcactgtctgaaggttctcatttttcaaaaagcacctggagcgagcatctctcgcatatactttttgcaggttaattctattttggagacttcttagcttaagatgagccctaagtggacagctgtttagtttcagaacagtctcccccatgtgtatgtgctggtgagtgacacgctccacctgcctgcaggagctgctgcctccttacatctcccagccatgcatcgcgcctttccctttgggaagcacttaatgagccataggctcctgaaagtggaaagagaacacgaaagggcctctggtcctgctgacaaagtcatttccgctgcgcctggtgctttttggttttcacattggattcacttcacttttaattaaagaaacgagatttgtgtgtttctttttgattttggtcatcttccccaaattaaggctctgtctctcaaacaggaagttaacatttattcaagtcaggaacataggggctagcttttccttttccacagatgtacctgagatatttggccaaacttgtccctacattcaaagatctctggtgggattacatagcctaaacgaactcaactactaagttatctttggctatcttcagatatgacccactgatatggtttggctctgtgtccccacccaaacctcagcttgaattttactccccataatccccacatggtgagggtgggacctggtgggaggtatttgaatcatgggcagtttcccccatgctgttctcatgatagtgagtgagttctcatgagatctgatggttttataagcgtctgtcatttcctctgcttgcattcattctctctcctgccgccctgtaaagaggtgccttctgccatgattgtaagtttcctgaggcttccccagccatgtggaactgtgagtcaattaaaactctttttttatagttacccagtctcaggtatttcttcattgcagcatgagaatggacaaatacacccacatagctatcttctttattcatggatataattcttacagttagcaatagacaaaattggacccttttttagtgttacactagctcaattgcatagacatccagtgacctacagctttcctaagactctaatgtttaaagcactgtcatgccccgggccctctctcggcactgccccaaggaagtttgactttgcctctctgtggctcagatttccgtagacagttggaaaggcacccaacaaacaccccatccatccatattcatgcaacttctttatggtttaatttaatagagtttgcctccccactgaatccaattttaacacaaaaacaaataaatttctacttcaacgaaaaggaggagaagatgcctatactttgcttatctctgtgggctattccattgtatcttaacctaaggaaagtggtcttttggggaatacatagaaattataatggagcaattaggcagctcaatgaaacaaaaagacatttaattcaatcaattgaataaggagaacaatcacattcaatatggtactagtgtatcatgtgtggaatatttgtgcatttccaaatctcttgatacaccacaaaacacactcaagtttcatggccttagttaactgatctgcaaaaaaataaacatccctcagtcattcctacatgacctcataataacccatatttctacttttctttcctgctgccttttcttgtagctcactacttaaacttctaggccgggtgcggtggctcacgcctgtaatcctagcactttgggaggatgaggcggaaagattgcctgagctcagaagttcaagactagcctgggcaacacagtgaaaccctatctctactaaaatacagaaaaaaattagccaggtgtggcggcatgtgcctgtagtcccagctacttggaaggctgaggcaggagaattgctgaacccgggaagtggaggttgcagtgagccgagattgcgccactacactccagcctaggcgaaagcgagactctctcaaaaacaaaaacaaaaacaaaaacaaaaaaaacttctaacaaaatgccttccagcctcagaacacttccaaagtgctgtcccaactagctcctgattttccttttatctagcaccttcacctgcacaacttgaaccctttacctacattattcttcttacaaaactcattatgggctgggcgcagtggctcacgcctgtgatcccagcactttgggaggccaaggtgggcagatacccaaggtcgggagtttgagaccagcctgaccaacgtcgagaaaccccgtctctagtaaaaatacaaaattagctgggcgtggtgatgcatgcctgtaatcctagctactcaggaggctgaggcaagagaattgcctgaacccaggaggcagaggttgcagtgagccaagatcgtaccattgcactccagcctgggcaacaagagcaaaactctgtctcaaaaacaaaacaaaacaaaacaaaacaaaaactcatctcttcagaaaggccataggtttccttgcctctggattccttgtgtcccccatagtacattcattgtcccttcgatctccatggctcctcttctaggctttgccacaaatggtaagccttctttctgtgggtcttttctgcatgatcacactcacctcgtgtgtgagtaaaacacgaaaaattaaatttcaaacccagacctgtctgcttcgctctagtccttgagtcacattctcatctctctctttttttatttttatttttgttgagatggagtctctgtcgcccaggctggagtgcaatggtgcgatcatggctcactgcaacggccgactccctggttcaagcgattctcctgcctcagcctcccgagtagctgggattacaggcacgcaccaccaagcccagctaatttttgtatttttattagagatgaggtttcacagtattggccaggatggccttgatctcctgacctcgtgatccacccacctcggcctcccaaagtgctgggattacaggtgtgagccaccgcgcccggcctcattctcatctctttctaatggtgaggcctgacatcatctggaactgaagagattctacaatgagctccaggtttcattctctcttccatgcgggcacagtctacctctcccttccatgcgggcacagtctacctctcccttccatgtgggcacagtctacctctccctttcatgagggcacagtctacctcagtcaaccagtctcaaatcttcagggtcgtgtaaacttccaggcccttaaaacctccgaacccaagttgggatcactgcactggggctgtctttgttcctcctgctttccctgcactgccattttgttcattcagcttcataaaacccgctgaaagaaccagtgtaatcatctttaaattagtcaaccaaagttgacactttcatttttaaacttttaaatctattatcctaactttagtaccctttatctgatccctaactttttaactttgagatttgacttcctaatttttaaaagtttacaataaaaaataattttgaatacatagttttacttgtacttaaaactgatgtgaaaaaagtaattaatttttaatgcttgtattttatcttaaagactggctgggcgcggtggctcatgcctataatcccagaactttgggaggccgaggtgggtcaatcacttgaggtcaggagttcgaggccagcctggtcaacatggtgaaaccccatctgaactaaaaatactaaaattagctgggcatggtgtggtgtgcgcctgtaattccagctacttgggaggctgaggcacgagaatcccttgaacctgggaggcagacgttgcagtgtgccaagatcacaccactgcacttcagcctgggtgacagagcaagactctgtctcaaaaaaaaaaaaagacgaatacaattttagatttaaaaaagaaaaagtgttaaaataattacttttaatttatgtagtgagaagaattaaaaagtaaataatatttgttttagctacagtacatagatcatatttgtcttatgaactttaatttttaaataacatgcacatgtacaatataaacttcaggagagtgggaactttatctccaatgcctgcaaaagtacctgatacttagtaggtgcttacaaatatttgctgacttaatgactatacaattcattggctacaaaatggtaaaaagtgaaaagtaacttttccttttatccctatagatacctggtttctacccccagaggcagtcgcaactttatttgttttgtctttctctagagatattataagcccacctaagcatgtgtatatctatataaagacagttagacatatatgcgtgtatgtacacaccatagatatccttttttctaccttcaaatgggaacatcttgtacatatttcctgtattctaccttttgcctcaactgtattttgggtgtaattttatatcaattttgggaaaactctctcttctttataaaagtgacatagcattccttgtataactgtgtcctcaatttatttgaccaatcttttattggtggtatttcaatttctagaattttgtgatttttttttttttctttagacagaagtttgttcttgctgcccaggctggagtgcagtggcacgatctcggctcaccgcaacctccgcctcccaggttcaagtgattctcctgaatcagccttccgagtagctgggattacaggcatgcgccaccatgcccggctaattttgtgtttttagtagagatggggtttctccatgttggtcaggctggtcttgaactcctgacctcaggtgatccacccgcctcggcctcccaaagtgctgggattacaggcgtgagccactgtgcccggccgaattttgtgatttttaaacaatgctgtactacgtgttcttgtatggatagcattgctcatacatatgagtgtttggaaaataatttttccttgtgcggctataacaaaacacttgagaccagataatttattaagaacagaaatttattttctcacaattttggaagctgggaagtccaaggtcaaggtgccagttgtctggtgagggctgccttctgcttccgagatggcaccttgatgctgtaccctctggaggggtagacgtgctgtgtcctcacatggcagaaggcagaaggacaaggaagccaaaacctgggtaaagcctatatatatatatatatatatatatatatattatatatatatggctttaaaggtgtatacacacacacacaaaggccttatatatacaatttacatacacatatatatacacatgccttaattccattcacaagggaaggagctttcctggccctcccttaacacctgaattttggaggtgacacattaaaaccatagcaatatcctagaagtaaaactgccatatcaaagagtaaatgcatttaaaattttaatgaatattggcaaattttcttccatggattatgtcagtttatacttccatcagcaatgtataaaagcaccattttccttcacactggccaacacattgctatcacattttgagatcattataatttatagttgaaaagcgatatcacactattactttaatgttcttttctttaatgtgaaatttattaattatcctcacattctaaaggcattaatgattacatttttgtaattgccagggactgtttacattttaccaactgatttttgccattattttcttccttcattttcctttcttttttccttccttccttccttccttccctcctttcttcctttcttttctttctttcctttctttcttccttttttattttttcttagacaggatctcacttgttgcccaggccgcagtgcagtggtgcaatctcggctcactgcagcctccatctcctgggctcaagtgatcctcccacctcagcctcctgaagagctgggaccacaggcacaaaccaccacacccagctaatttattttttaaaatgtatgggtctggggtctccctatgttgcccaggctggtctgaaactcctgggctcaagccgtcctcctgtcttggcctcccaaagttctgggattacgggcatgagccacagtaccctgcttcactgtttcctgctctattggtcataatttcactcattatttcctcactttttccctcacgtttctccacttcttcacctcgacggctttgcatgtgtaattctctgttttggaattgcctctctccagcctctccctccatcttcaattggaatcttaattccatatgcacagaatagctccaagtggtagtggaggggagaaacttgtaacaaggggtcctgggtggaagaactggcacacggggtcagagatttcagggaaacttacttttcactgcaacaccttttgtacctttgcatcttgtaggaagcttacatgtaacctctatacaagcaaacacaggcaaaaacacacacattgtcaattcacatccttatttgtcaaggtatagcttgaatgtaatttttagctaaaaagttgtttatctttactcttaacattcatggaaagtaactacatacgtataacatacctataagttgtataacatatacatttttatagaaaaataaacatatttcttttataacttgctaacttcttgattgagaatctctgattattctttgagtcctgccaacatgtctagcatatttcttaatcaatgtaggcattcaaaaactgtttaattcatttagcaaatatttattgagcctctgttctgggaaagtatcttagtaatcaccggcagtagaatttacagtcacagtccttgcccttagacatcccagttaatgatgaagataaacacagagataaataattctaataggtacaatttagagacatgcaaagaaggggaatgataaacatcaagtgattatttatctccgcatttcccaaggactgagtcaagtagcatcttctcatgataattttggtgatcaccaggaaagctttttattagataacgatttattgcagaaaatacataaaaaactaatacttttgcagagattaattttgtgtgaggttaaagtagacatttaatttaaagaagttagtcactgaaagtaaaatattcagtaaataagagtttcgacagaacatagccactgcaacagtagtggagcagaggtgagcacaaccgaggctgcggcaggagaatggcgtgaacccgggaggcggagcttgcagtgagccgagatcgcgcccctgcactccagcctgggcaacagagccagactccatctcaaaacaaaaacaaaaacaaaaagaaaaccaacaactgaagcttggcacatgttaatctgtcccaaccaggcacacattgccttggtaatgataattataattaaatattagtatagcttccctgtgttgagggtttactctgtgtcaagcattatgttatggactttatatctcatttaacagtcacaatctcccaaggacgcttatattttcttgagacaacagaggctgagagaacgtaatgaaatggcacagataactaaaagtttattctttaattgccatgcaactacacccagtaggagccaaatattggaggaaaggatcgctaaagattttgaccttgtaaattttgactttgagtgagaaaagcaagtgccagatgaataaataaccctttttgagaggtgctatgaataagtattatgagcatgcagggcaggagaggattggggatggaagccaggtcagggaagggttccttgaggagatgatgctgaagtgggctcggacgaatgcatcagcattaactaggcgttaacaaaggaagctctaagtggaagtgcctgggagaacacacacagaggcccctgtggtggagccagagagcttcacggtgccacggaccgtggtggagccagagagcttcacggtgccacggaccgcggtggagccagagagcttcacggtcccacagactgtggtcccagcgggcctctgtttctgcagccttgcccaaagtaggttgtcaacattttgaattactgacaaattcaagggtaagaaacgttatctccggtagatttagtttgcattttccttattaagaacatcttttataagcttaagaacaatttacattcttctgtaaactacttcttacattctttgcctattttcctgtttgtttcctcattcatttgaaaaagcatctcatagattaagttagtttcttgtctatgatataagacatatatttgctttctaatttaacatttatttcatctttattattttaaatttttagttatgtgaaaaattttaattattattattattataattttttttttgagacagagttttgctcttgttgcccaggctggagtgaatggaacgatctcagctcacctcaacctccgcctcccaggttcaagcgattctcctgcctcagcctcccgagtagctgggactacaggcatgcaccaccacgcccagctaattttgtatttttagtagagacagggtttctccatgttggtcaggctggtgtctaactcctgacctcaggtgatctgcctgtctcggcttcccaaagtgctgggattacaggcgtgagccactgcgcccggccttattttaaaagtcaaatcaatctgtgatttttgttgtttttgagtttaatatactgaggaggctaatatattccaattttataaaagtattcaactgtgttttcttttagcacttttatggtatcagttttgaagtgtaagtatgtgaacattgggatttattttggtttaaagtgtgaggtagagatacaattaatttttttcttcaaatagctcctcttgttgcaacactatttgtagaataatccatctttctcaattgatttgaaatatcacctttatcaatactagatttccatatgtatttgagtcttttactggacttcattctgtttcattgatgagtctatatcttcatattctagtaatactgtgttttcaatgttattattattattttattcatttatttatttacttatttgtttatttattttgagacggagtctcgctctatctcccaggctggagtgcagtggcccagtctctgctcactgcaacctctgcctcccaggtttaagtgattctcctgcctcagcctcccaagtagctgggattacaggtaactgccaccacgcccagctaatttttgtatttttagtagagatggggtttcaccatattagccaggcttgtctcgaactcctgaccctgtgattcatctgccttgacctcccaaagtgctgggattacaagcgtgagccactgcacccagcctaattattattgttttattatcttgtagggctaattacttgcataaagtatttctcagatttatacttttgcctgttattcttattcacttatttttccataccttcttcagaatcagatttctagtttaaaaaattcctgttaaaattgttattgagcattagatggaagcagcatgggtaggagccgtggggctgtttccgggagggtattccaggcctaatggccagcatgtgtcagggcctcgactggcagtgcgtgttgtgtgtttgaagaacaggggagttggagttactgcagcagagagttcagtctgaggaggggagatgggagataatgccctagtgggggtggaggtgggacatgagggtccagatcacccttggggcccttgtaggccattataagactctgacttttagtctgaatgagatgaaaagtccctggcagatttacagcatagaaatatcatacaaaaatttggggcagggtgcagtggctcacacccataatcccagcactttgggaggctgaggcaggcagatcatttgagcccaggagttccagaccagctttgacaacatggcgaaaccccttctctgcaaaaaaatgcaaaaattagctgagcgtggtggtcctcgcctgtaatcccagctactcaggaggctgaggtgggagtcactttaacccaggaggcggaggttgtagagagttgagatcgcgccactgcactccagcttgggcaagacagcgagacccttatcaagaaataaaaataaaaaataaattttattttattttatttttctatctgttaaatatccaaccaattcatttctgggcatctatctgaaatattcaacatacgccaccctactcccgcccccaccccaacaagagaaagaaaaagcattgtagaaagattattacagcacagcttgttacagtgaaaaactgacagctaaaatgcatattaatagagaaatgattttaaaaatctgtgctgtgcccgtactatacaatactaacatgcagttaaatgcacagaataagtttgaaagcgcagaaaaataaatagcgctcttatgagaccgggcgcggtggctcacgcctgtcatcccagcactttgggaggctgaggcgggcggatgacctgaggtcaggggttcgagaccagcctggccaacatggagaaaccccatctctactaaaaatacaaaattagccgggcatggtggtgcatgcctgtaatcccagctactccggaggctgaggtaggagaatcgcttgagcgaggcagaggttgcggtaagccgagatcacgccactgcactccagtctgggcaacaagagcgaaaataaaaaaacaaacacaaacaaacaaacaaaaagaaatatagctatcacgttgacaacaaagtggtacataagggaggctgtggcttggctttggagctgctcaccggaatgtccgtggtgcagtgacggcgtccacgattcgggtcagagctctccaggacaggtggggtagagctggaacaagacgggcaggtgctggcgctcactgaggctactctggcaacacatgaggacgcattttatttttctccccacttttaatacgtttgaaaattccataaaagtaaaacaaaacaaaaataataaaaattcattaaagactgaaccataaaagtcagaaaatttttccacaacagccttggccattgctgtattgtgcattgaaggcggctcttagtgaagagacacatttgtaataaatgttttgatgtactagacaatcagggctctgaggattgaatgagatgatccgtgtaaactacttagcctggaattctcaggacatataaatctaaaagtttttatggaagttgattttattactcaaaatatattacagtaattttgtaaatctattttatctctctatctctatataatttgtcttctgtttaatagctacagaatgtttcttaatttatttagccattcccctattgaccttttctccttttataacaattttgtaataaatgtctcataatatgtatttgtgcacctgcccaattctttccatgaggtaagtcccagaactggatatggtaaacaccaatgcattttcatatatcttttttccaatttgccctgcaaagagattgtactcatatacacaccctccagttaatggtggcagtgtctgattcttcacacccttgtcaacaaggaactagacacatgcattattagtgaaggcaagtgcatatggactgtgtatttttgtctcttccaaggtgaaatacatttttatgtcctcaacttgttttgtattggattctttgtcttttctttattgatgtgttagaactctttatagtaagactattaatattttgtcacatatgttacagaacattttctctagtttgccatttgtctttaatttcatgtagttttaaatatttcagccttcattttaggctatctgggatttattgcatgcttagaaaagccttttatatttcagaattaaaaagctttttttggtaaactctttcacactgttggattttgtttgaacttctgtttttaagccatctggcatttatttttattttattttactttattttatttttttatgattttttaatttttttattgtactttaagttctagggtacatgtgcacaacgtgcaggtttgttacgtatgtatacatgtgccatgttggtgtgctgcacccattaactcgacatttacattaggtatatctcctaatgctatccctcccccctcccgccaccccatgacaggccccaatgtgtgatgttccccaccctgtgtccaagtgttctcattgttcaattccccacctatgagtgagaacatgtggtgtttggttttttatccttgcgatagtttgctgagaatgatggtttccagcttcatccatgtccctacaaaggacatgaactcacccttttttatggctgcatagtattccatagtgtatatgtgccacattttcttaatccagtctatcattgatggacatttgggttggttccaagtctttgctgttgtgaatagtgccacaataaacatatgtgtgcatgtgtctttatagcagcaagatttacaatcctttgggtatatacccagtaatgggatggctgggtcaaatggtatttccagttctagatccttaaggaatcgccacagtcttccacagtggttgaactagtttacagtcccacccacagttttactttattttatttagagacagggtcttgctctgttgccaagcctggagtgcagtagcacaatcatagctcacttcagccttgaccccctgggctcaagcaatcctcctgcctcagcctcccaagtacctgaggctacaggcacatgccactattcctggctaatttttaaatttttttgtagagacagggtcttgtccaggctggtctcaaactcctggtctcaagcaatccttctgcctcagcctcccaaagtgctggaattataggcatgagacactgggccaagcctggaatttgttactgcagttaggatatatgttttattcctaaatgtagcctactgtcccaacctgttaattgaagagtttattatctatatctggttgggattctccatatcattatttttcttttaggcacttttattggctattttcatacttactatttcgtgtactttagaaacagtttttgcattccaagacaattctggagagactatttttggactcacattggaaattaggtgagaattggcatttgtctttatacaagtgttccacttaggaaaattgtgcgtcctcccacttttaaagtcttttaagtaagtcttattttttatatatatgtatatattatacatatatataaaatatatatattatacatattttacatatgtatttttacacacacatatatatatatatacacaaatatatatatatatatatacacaaatatatatatatatatatatatatatatatatatatatatatatatatatatatttgagacagagtctcactgcgtcccccagggctggagtgcagtggcgcgatcttggctcactgcagtctctgcctcccaggttcaagcagattctcctgcctcggtctcccaagtagctgggattacaggtgcccaccaccacgcctggctaatttttgtatttttagtaaagacagggtttcactatgttggccagggtggtcttgaactcctgacctcgtgatccacccgttttggactcccaaagtgctaggattacaggcatgagccaccatgcctggctgaagtaagtcttatgattaacttccccataaatctttcacatttcttattaattcctaggtattttataatattgaaggttttaaaaaatttcagagatcatttttgccattctattttttaacttagttaccactaagacaacatctacaaaatgctgtagatctctgcgcacacacaaacacacacacatcatgcaacaaataagaaaatgccaatacatgaattatacgtgagatgttggatatattattttattggcacatgtcttagaactcattacacttctaggtacatatccatgagacaccaatgcatgcgaccatcaaaaacatgaacaataatatttacagaagtttcattaacaataactaaaatttagaagcaatctaaatgtccaccaataggagaacagatgagcaaatgggatacgatacagacagaagcaacaataataaaatccctactgatgtggatacacatgaaaaatctcatgaccctcatcttgagcaaaagaaacttcacatcaagaaatgcatactcttttattccatttatataaagttcaagaacaggcaaaactaatcttgtaataaaaatcagggccaggcatggtatctcacacctgtcatcccagcaatttgggagaccgaggcaggcagatctcaggagtttgagactagcctgggcaacatggcggaaccctgtctctaccaaaaatacaaaaaaaaaaaataagaaattagctgagcatggtggcacgcatgtgtagtcccagctacttgggaggctgaggtgggaggatcgcttcagcctgtgtgacaaagtgaaaaaagtcagaataatggctatctgttgagagattaggtactatctgggaagggtatcagatgaccttggagcctgttggacattttttgaatcttgatctaggtggtaacgtcactggtagataagcactgtatataaaagctcattgaatttacacttaagatttgttcacctgattcaatataaaatttacctaattttcggccagccgccccgtctgggaggtgaggggcgcctctgcccggccgcccctactgggaagtgaggagcccctctgcccggccaccaccccgtctgggaggtgtacccaacagctcattgagaatgggccaggatgacaatggcggctttgtggaatagaaaggcgggaaaggtgggggaaagattgagaaatcggatggttgccgtgtctgtgtagaaagaagtagacatgggagacttttcattttgttctgtactaagaaaaattcttctgccttgggatcctgttgatctgtcaccttacccccaaccctgtgctctctgaaacatgtgctgtgtccactcagggttaaatggattaagggcggtgccagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactactgtcccatgaccctgccaaatccccctctgtgagaaacacccaagaattatcaataaaaaaataaattaaaaaaaaaaaatttacctaattttataaaaagtaagcttcctaataggcttctgtatatctagtcatgaaataaaagttaaaataaggctgagcgtggtgactcatgcctgtaatcccagaactttgagaggccgaggtgggcggatcacctgaggtcaagagttcgagaccagtctggccaacatgatgaaatcccatctctactaaaaatacaaaaaattggccaagcatggtggtgggtgcctgtaatcccagctactcaggaggctaaggcaggagaaccgcttgaacccggaaggcggaggttgcagcgagctgagatcgcgccactgcactccagcctgggcaacaagagtgaacctccgtctcaaaaaaaaaaaaaaagttaaaataaaacaaaagcaaaagactctcaaaacaaatcaaagagcagccaaataagcaactaataaaaagaaagtcattgtctggcttgtgcccaaaatgtactcatcagtctaagactcagatcattctaagcaccaatactttgacctgctttctatggagacccctgactattcaacttagcacatccccagaggacctttcctctacacttggctcatcctctgtgctccgtatttctcttcctgacatttctatctgcccgtctcccaagccacaaattacagcatcccattttacactctataataactgaatatcgtctcatatcaatctcttagcccttttactaacactgtcttcaaatggggtacaaaaatagctttctaatagaatcctcccaacccaatttctggctccagcatattttgcaaaaggctgtcagtttgatttcctcgcacagtgcttctggaaaggatggcagtgttgtagacctgctgcatctgatatggtcactgctagccacaggtggctactgggtacttaaatgtgctcagctggctgaagaactgacgttttcatttcattttgttttaatcagtttgaatttagttaagcacatgtggctagtggctagtgtgttggtcggtacagttctagaaggaaagctctgagctgtgcccctctctccaggtggaattagattttatatattcactgactcaggcctgagcaggactggtatcagcctaacggcccctcttcatccaatacaaacataattttgcatatcagacttcaagctgcatttgttcttttaattctcctcaagtaattgtataggaacctttttttttttttttttttttttgagacagagtcttgctgtatcgcccaggctggagtacagtggtgtgacctcggctcactgcaacctctgcctcccggttcaagcaattctcctgcctcagcctcctgagtagctgggactataggcgcaggccactacgtccagctagttttttgtattttttagtaaagatggggtttcaccatattggccaggttggtctcaaactcctgacctcatgatccactcgcctcggcctcccaaagtgctgggattacaggtgaaagccaccacacccagccaggaactactttttaatgcaagcgtctttctcactgctgaccatggatcctggattatttttaagtggctgggcccggttctacagatatatcaaaaggctcccaatctctatgcattatgtccatttgaaaggcactatacttggccaggtgtggtggctcacgcctgtaatcccagcactttgggaagctgaggtgggcagatcaactgtggtcaggagtttgagaccagcctggccaacatggtgaaaccctgtctctattaaaaatacaaaaattagctgggtgtggtggtgcacgcctgtaatcccagctacttgggaggctgaggcaggagaatcgcttgaacctgggaggcagaggtggcagtgagccaagactgagccactgcattccagcctgggcgacagagcaaggctctgtctcgaaaaaaaaaaaaaagaaatgcactttctggccaggcgcggtagttcacacctgtaatcccagcactttgggaggccaaggcgggtggatcacgaggtcagaggttcgagaccagagtggccaacatggtgaaaccctgtctctattaaaaatacaaaaattagccaggtttggtggtgcacgcctgtaatcccagctactcgggaggcaggagaatcacttgaacctgggaggtggaggttgcagtgagccgagatcacaccattgcactccagcctgggcaacaggtgagattccgtctcacaaaaaacaaaaaacaaaaaacaaaaacaaaagaaatgcactttcctggaaacttcagcccaaaatagcaaaattaagtgtgattgaaaccaggttgtattgtctatcatatgtacagataagcaaaaattataaacaacataactggattcaataaaaacttgggtaattcatttatgggaaaccaatagcctgtagccatgtagctattagaatgattagatttgtactgacacagaaagatgtatcaaattataatatgaaatcagcaggatctaaaattctaaatatcccaattctactttatttttaatataaaaatatgtatacaatcatacagaaataaatagaaagaaaacacattaaaatgttagcagcactggtttatctccaggtggtagaatttgatgtagccaatccaaattttctctataactggtattaacactctttaaaaatgaaaacagatttcaatattaaaatattcagtatacttctaaagccagattttttttttttttgaggcggagtttcactcctgatgcctaggctggagtgcaatggcaccgtctcagctcactgaaacctccacctcgtggattcaagtgattttcttgcttcatcctcccaagtaactgggattacaggtgcccaccaccatacccagctaagtttttgtattttcagtagagatggagtttcatcatgttggccaggctggtctcgaactcctgagctcaggtgattcacccacctcagcctcccaaagtggtgggattacaggcatgagtcaccgtgcctggccagatattctttacattttgaattagtggccaggcatagtagcatttccctgtagtcccagctacttaggagtgaggtgaaggtgggaggatcacttgagcccaggagttctaggctgcagggagccgtgatttgtgccactgcactctagcctaggtgacagagcaaaaccctgtctctaaaataaattaaaataaaaattctgaattagtgactgttttctgtaaaattcggagctacaacaccaggcgaaccagaagccccacgtataaggttttaattatttaacaatggccattttcttttcttttctttttttttttttttttgagacagagtctcactctgtcgcccaggctggagtgcagtggtgggatctcggctcactgcaagctccgcctcctgggttcaagtgattctcctgcctcagcctcctgagtagctgtgattacaggcgtgtgccatcatgcccagctaatttttgtatttttagtaaagacggggtttcaccatattggttaggctgatcttgaactcctgaccttgtgatctgcccatcttgtcctcccaaagtgctgggattataggcatgagccatcacgcccagccaacactggccattttctaatagagattctgaaaaaggaaatatgtaagactctgtatatagactctgtacacagactctgtatataagtatcagtctctgttgggagtgccattctaaggaatgattaccaattctgaaattcagaaaaggatctatgtaaacataacaaccgaggccaggcacggtgcctcatgcctgtaatcccgcactttgggaggccaagcagggtggatcacttgaggtcaggagtttgagaccagcctggccaacatggtgaaaccccatctgtactaaaaatacaaaaattagccaggtgtggtggtagatgcctataattccagttacttaggaggctgaggcaggagaattgcttgagcctgggaggcagaggttgcaacgagctgagatcgtgccactgcactccagccttgtgacagggtaagaatctgcctcaaaaaaaaaaaaaaaaaaagaaaaagaaaagaaagaaagaaagaaaaaccaattgaaaagagaaaaaaactattcattaaaggaggttttttttttttttttttttaacaatctcacagtgtcacagtggggaggatttgtccaaacataacgcaaacttcaaaaactacagaagatttgactacttggcaaagaccacaagaaaaaccatcaaaacaagcagctgagagaaatctgcaactgacatcatagacaaaggattaacttccttaatctgtaaatactgtctgtaaaccaagaaaactagacaatgcaagtatacacaagttatcaatacaagctgggtgcagtggctcatgccttgtagtccctgcactttgagaggcagagatgggaggatcacttgagccaatgagtttgagaccagcttggggtgcatagtgagataccatctctacaaaaaaaaaaaaaaaaggaaaaaaaagacatataggctgggcacggtggctcactcctgtaattccagcacattgggaggccgaagtggacagatcacctgaggtccagggttcaagaccagcctggctaacatggcaaaccctcatctctactaaaaatacaaaaattggccaggtgtgttggcgggtgcctgtagtcccagctacccgggaggctgaggcagaagaatcacttgaactcaggaggtggaagttgcagtgagccgagatggtgccactgcactccagccttggagacagagtgagactccgtctcaaaaaaaaaaaaaagatatataaatacagaatagtagttatttcagggaggaagggagacaaaagcaatcagggagaagtccacagaaagtttctaaggtactagttaatatcctattctttgttgtataaactaggtgacgggtacagaggtgttttattattcttaagtctctttgtgtgaacatgtgtatgcgtgtatatacacatacatttacacacactaatatacatgcatatattctgtatttagagtaaaaaaaaaatcacatgcattaaagttttgattacaccacgggctggagtaaaggggaagagagacttgcaagtaaaaatgtatgtgagcatttctctggagaactatgacatctataaaaattccaatgcacataatttttgatccagtatttctacctccaggaaattcactccacatatataactgcacatgtattatatgaaattacattatacaaatctatttattgtaacatcatgtgttttagtgaaaatttgaaaacaaattattgacagggagcctaatatataaaacacactactgtgcttttgaatacacatgcagctgtagccacacacacacaaacacacacacacacacacacacacacacacacacacacaaagtctttagatagaatttcatgagatcggccggaggcggtggctcacgcctgtaatccccccgctttgggaggctgaggcaggcagatctcctgaggctgggatttcaagaccagcctggctaacaaggcgaaaccctgactctactaaaaatacaaaattagccgggcgtggtggcgcatgcctgtaattccagctacccaggaggctgaggcaggaaaattgcttgaacccaccagacggaggttgtgtgagccgagatcgcgccactgcactccaacctgggtgaaaatgagactttttctcaaaaaaaaaaataatttcataatatattatttggggaaaaatatatagaaaagtatgacataattggtttattaaaaagaaatatatacattcagactctctgtagagggatatctgatagagaaatagatatggaaagtgtattatctattcaagaaataagttttaaaaacaagtttccacatagacttgtaatttaatgatcataccaaattaactgcatcttgtgattatacgtagaatgatttcagtcacacaaattaaaaccttaacagaggaaagggaattgcaaaaaatattctctatcaaattaattatacttgtattggggtaatgaaactcagaggggcagttcatatttctccatttttataatgaaagttcacagatttgtaatacacttagtgtgtttcataagctataatagagagttgtcctgacaatatttgaagaaaaatgacattagttccttcctcctgtgtaggaaaaacattcagttgctcttccaggtcattcaacaaagaccttttctttcttttttctttttttttgagaccgaattttgctcttgttgcccaggctggagtgcaatggcgcgatctctgctcactgcaacctccgcctccctagtgcaagcgattctcctgcctcagcctcctcagtagctgggattacaggcatgtgacaccatgcccggctaattttgtatttttagtagagtcggggttttgctatgttagccaggctagtcttgaactcaacctcaggtgatctgcccacctcggtctcccaaagtgctgagattataggtgtgagctaccatgcctggccatgaccttttctttttttaacctcagctttttattttgaaaaaagccaaatctcagtaaagttgaaaaagaattctaatgaccatctctacatatgtccatgttttgcaaaattgggcttatcactttctcgctgttctcagacacacatacacattcaggctcttgttttgatttgacaaaaatcagataactctgtgtagtcctcagtcctcacagtattctcagatggcagcgttacagagcagccagggttcagttgtgaaccaaaagaactgttctaactcctcccccaccctcaggaggaaagcaattcactggagacctgtatatccattctagtctaccagagagggcctgggacagaattgtatggttacagtaagctgaggaggtatcttttcgttgattcaccaatatgttctgaattgggactctggtatctaggaacacatattccaatggtagaagatcattcttttatatgatgtgaccgagtacaggagatgtatcttatggctaggaattttctgtgtaaacccatgcatcagagaaaaagatgaaatcagatatatacctttcactgagggattatcaatccatctctaggcctcgaattccttactattatttagaacatcgtcaacctgctgttgaaaatgaaataaacatcttctgcaaagtttatttattttttattttattattattttttttttgagacagagtctcgctctgtcaccaggctggagtgcaatggcgcgatctcggctcactgcagcctccgcctcccgggttcaagcaactctcctgcctcagcctcccgagtagctgggattacctgctcaatgctgttgtagcagagggggaacatccccagggagctgcagactggtgggaagagcaggcaggcacactcgacacagaagcccagacaaacccttggtatcatgagtggctcaaggtcagagataaccaggcccgtacatgctgtctttccacgtcagacttgtattgatgctatttaaatcataaaagccaccagctccatggagttcccagggaggcagttctccttagtacttcctggtcactcggtggtcagagctgcgggcacacaggctcaagccactccacatgtcagtcgatattgcaaaccatacatcatagtatacctaattaatatatcaatgttggccgggcgcagtgtctcacgcctgtaatcccagcactttgggaggccgaaacgggcggatcacgaggtcaggagatcgaggccatcctggctaacaccgtgaaaccccgtctctactaaaaatacaaaaaattagcagggcgtggtggtgggcacctgtagtctcggctactcgggagactgaggcaagagaatggcgtgaacccgggaggcgaagcttgcagtgagccaagatcgtgccactgcactccagcctgggtgacagagtgagactccgtctcaaaaaaacaaaacaaaacaaaattccacaacaaacaaagtagcatttaacaccaagagaaaggggataggaaagagcgttaatgaaccagtcccaaagaatctcctggtctggcccaggtggcccatcagtcttgcaaggaagagtctttgatgtgggcagagcctttggtggtagattctgggtaccaattaccagtgacagcaagatggggtctgttaagatggctgtttcgagctggtgaagtcctgctgtttgatagccccagagtcctctggtgaggactgattgtggaggagtgtgcctggtgatgcccttatctggctggatgcactctttgttgatcaggtgaaacatttggtccctgttggcaaagtgctttgtgaaatagaagatggagtcttttgttaagatggaattacttatgtcaatggtgttgtatacacttgacaaggccagatgacattcccaatttgtttttataaatagtagagaaacttcgctggaggaggagggtcacacatagcaagagcagagggcttggtgcatcttccattccagatgctactgagaatgtgcaaatcagtgtcacgacggatcccaaaggtttcatttcaaactgagccatggacattttatagtgcctaacttactattcaaaaatactcacacacacagttttgtttgtaacatttccactcatagaaattccacaggctttggtataggaagtgtcagcggaacacacctttaccctggggtaaaaagcatagtcttccctcacagttaatgctctcaatcttctgattctgggtgtctggtagatcttgtgtccccagaggataaatcaatgtattttaaaagtattaataatcagtttacagccatgcattgttttataatggggacatatgctgagaaatgcatcattaggcaattgtgcattgtgtgaacatcatagagtgtacttacacaaacagatggtgtagcctcctaacacacctagattatttggtacagcctattgctcctaggtacaaacctgtccagcatatgactgtactgaaaatgtaggctgaaaattttattttacatatgtaggcagctgtaacacaatgtaaatatttgtgtttctaaacctggaagaagcacagtaaaaatacagtattataatctcatgagaccaccgtcgtatatgtccgcagttgactggagccgtcattaggcagcatatgactgtagtccattaattttaagtattcaaaacaatttccatccattcacaattcaaacaattgctcacaattttgtacagctattaatccaggaaaccattagcctaggaagccaaatgtttagttagacacaagtttagggaaacatttgagtattgctggaggacaaaagcactcactaaataaccagtggctgattaccggcctctggaccatggccagttggaatagctccatgtcattctttctttctttctcttttttttaagttttgttattacaagaataattttctatattagactgttttcactttattaactttatcataagtatgccaacttctgcaaacttggagcaattgcaataatctattgatttattttcaccaaattttcactttatttgcccagaattcaagcttgtctgttaatttcccaggtcttcaatgacttgtctcttattggctagcatctccttattttccttgttcaattagtaaggttttccttattatattacttttttggggggcctttctctgttagtatatagattttctcctgagagctaaaaatcttcataacaccttagtcaatatacctttgaaaaaaccccttatattggctggttgcggtggctcacacctataatctcagcactttgggcggccgagatgggcagttcacctgaggtcaggagtttgagaccagcctggccaacaaggtgaaaccccgtctctactaaaaatacaaaaattagctggatgtggtggcaggcacctgtaatcccagctactcgggaggctgaggcaggagaactgcttgaacctgggaggcagaggttgcagtgagccaagatcacaccactgcactccagcctgggtgacaagagcgagcaaaactctgtctcaaaaaaaaaaaaaatcccttatattataattgtcattgaaataatctgacattcctagtaacctctgacactaaaattttcttcgcttttaatagaaacacaattcatcatttatccattatccattgttttgaatttaatttaattcaccaaaataatacatatattttagtaccaaagatcaaaaagtgctcgaaggtttataattaaaaaaaaaaaatcctctcttctcccccattccggctatctagatacagtcatgtccaactctcagttctttcttatagaatatgcatgatattccctcatctttcatttaagttaaggaatatcatgtatattctataagaaacagaatgaggcattctatttctatttccttagaaatagaaattggaaatagaaatctaaattggaaagattggccagttgcagtgactcacacctgtaatcccagcactttgggaagccaaggtggaggactgcttgagtccagaagtttgagaccagcctgggcaacagagcaagacaccatctctacaaaaaggtaaacaattagctgggcgtggcggtgcaagcctgtagtccacgctacttgggaagctgtggtagaagaatcccttgagtccaggaattcaaggctgcagaatgggcagaatgactgtgccactgcactccagcctgggtaacagggtgagaccctgtcgaaagaaaagaaaaaaaaaaagaaagaaaagagaaagaaagaaggattatcttttaccttttacttgctacagataacttccctgccacctcattccaatatagtcaaagcaacattttattaagccatcaacacctttgttttttatggagttaacagttctctctatatatatttagtttttttttcctagtgtaccaaacacagattcatcccttatactgtcctatggagctataaagcttttcttgacatagccaaacggctaggaaataatcaattctatttattttttccttcaaggtacccttctgtgaatcttccaccttttgttctaattagggccaactgatgctgtcgtcctgggaattttcccattcaccatcactttgctaattccttcacctctttgctttcctgtactcaggagacatccttggcaaaacttaatggttgctgggtcatgatgaaatattataggcatactagagaagctgcttgattaagtagccatcagttcgacaaaacaaaaaacaaaaacaaacaaaagctaatttgtagagttttttagataaaattgtcctgtgaaacttcaaaatcaagcttcctcatctgttcattaatgctgagatctttgttttgttccttcaggtaaggcaaatacccgacatacagggattgtttaataaacactttctgggtttcttgttcattcatttaacgcctttgccatcatggggtttccattccagacaggaagttaaatacataatgttaaatcaggtcatgattaatgctacaaagaaaataatgtagggtaagaggtaagagaatgagtggggattggagagaatgttcagggagggcgctctttgtggaggacagatcaagaaaggcctgtgtggtggcagccagctggagcctagcactgcggtccagatgaaagatcacagcctcaactagtgtggtcaaagggaggatggcgagtgtttgctgagggacatatatggatggtagagctgacagtctttgctgatagattgaacacagaatggcagcaaaataaaggatggctccaaagtctgtgctgtcagaatgagcccctgaagcttttagaatgcacggggtgcctgcgagggtggcacatttgggaatctagttggctctgactgaagctatggagaaacgtggcaaagaagtgaggaagaaaggatgctgaggcgggcttaggaggccctttattaaagcctggctgtgtttataatcgcaggcaagaagggaagctaatgtagtaattcagaaggatgaagagaactaaattgaggaaataggttttcatttttatcaagcaattcatcattgactacgactccacattaattcagctctacccataaagccaattaaattaccccaagaaatcaataaaaacacaggcagggtggggaagacattcttgatgaacattcacacgtcttttttataagtatttgggaagagatttcgggctaaaggggtgaagcatgttccctacatcactgtagacctaggaaacgaattctatttctccttttccctccatacaagcaatctaactccacaatgaagatagggacagcacattctcaggggaaattgacatggacagttcctggactatagctcactcctatctgaagctctgaatgttaacatccaatgtaggaacagcttttagcttcagaaattccacaggccaaagaacaatgataaccattaagaagattgcaacaggagcttttacctccaccctctttttcaaatacaaagttctcttgtatctctgagtatctggaatgaccacatagttctcctatctgaaataagacagacacacaaaacagggtaatctagctgaccagagagtgctgggataaacacaaagctcactaaaacggttagggaggggaaaagcttattcacatagttttaacttttttttttttttttgagacagtctcgttctgtcgcccagggtggagtgcagtggcgtgatcttggctcactgcaacctccacctcttgggttcaagcgattctcctgcctcagcctccagagtagctgggactacaggcgcccgccaccacgcccggataattttttgtatttttagtagagacggggtttcaccatgttagccaggatggtctcaatctcctgacctcgtgatctgcctgtctcggcctcccaaagtgttgggattacagacgtgagccactgcgcccggccaatgtttgtatttttagtagagacggggtttcaccatattggtcaggctggtcttgaactccggacctcgtgatccacctgcctcggcctcccaaaatgctgggattacaggcatgagccactgcacccagcctggttttaacctgttttttaattaaaaattttattttacataaatacactttttgaaaataattttaagtttccatcaacggcttcctttgagtaatgtgaacctcacttccacatctttgccaggcctcgacttccccaactctcccctccagtgagcctgttatctgtctgcaaatacttttaacgagatacaatttgtgtggttggaaagaataaacagcccaggtttcaagagtctgaatatcactctctggagattttgaatgtattggctctatttctgactcagttaaaaaaaaaaagtactgccacttagggtagatgaggtcatagaaagcattctgaaccttccctggcaggtagcaaatgtacgacaaactgaaattgctattttgaaaggagaagcaatatttacatttacatcctttctatttatcattctaccacatccatctatcattacagagaattccttcttctcatgtgaggttaaatttccaatctcatacttgattttttccaggtcaaaagtctcattctcttatatatgttccaatttgtcgaggcataactgaaatgcaaatttacccatgttttgccgttacccacctacgtgttttttaacttccatgtaccattgataatatttatcacattccagtcagaaaatccgaaaaatcaaagcttcaaattccttccttattccctgtgaattcttatctcctctctatcctgtaattccttttcctgctttgtgcaagatcaaaaaattaactgcagtgaggtcacttacctctctccttctttcagccctacacagactatttcaagctgactgccctgcctttccattgaagacagaaggagctggtctagattcctatgagctgtgagatttcctgagcctctcccgctaatccttaacccagaaatgtattcgtcatttggctataaaaaaactcacagcttgacatccctgcacatgtaagagcactttttccaagttataactacagaacaaaactagatattctactttattgatacatttgttgtccaaggtacatttaccatatacaaatacagagacatcttttcagtgtagtgaggtaatcccaggcgttccatagcactggaggccccactggccaaaggcttcctaggtctacttagctcaaatatccaactcttacactttcttttttttttttttttgagacagggttttgctctgtcacctaggctggagtgcagtgacttgctcttggctcactgcagcgtcgatctcccaggttcaagtgatcctcccaccgcagcctcctgagtatctgggactacaggtgtgtgccaccatgccaggctaatttctgtattttttgtagagacaagatctcgccttgttgcccaggctggtctggaactcctggactcaggtgatcctcctgccttggcctcccaaaatgctgagattacagatgtgagtcaccatgcctggccacttaccgcttttatttatttattttttttttgagatggagtcttgctctgtagcccaggctggagtacaatagcgtgatcttagctcactgcaacctctgccttccgggttcaagcgattctcctgcctcagcctcccgagtagctgggactacaggcgtgaaccatgatgcccagttaatttttgtattttttaaatagagacggggtttcaccatattggtcaggctggtcttaaattcctgaccttgtgatctgcctgccttgacctcccaaagtgctgggattacaggcatgagccactgcgcccagcccacttatcacttcttaaagctacttccaattatactttgcccaattaacaatcttcctaatacagctgtttcattataactaatccctagcaccatcaacacatttttacatttaaacagtaaaccgtacactacaccagagccactgaacaaaccgcctgttgttttctatttcttgcttctgccaactttgctgtttgtcttggttggatattgtaatcaactaaggagctttgaaaaaaaatgatgcctagttttcaaccccaaagattctgatataattcttgtggagatatggtttagatattaggatttataaaaacttctcaggtcagccgggtgcggtggctcacacctgtaatcccagcactttgggaggccgaggcgggcggatcacgaggtcaggagttcgagaccaacctggccaagatggtgaaaccctgtctctactaaaaatagaggaaattagccaggcttggtggcaggcgcctgtagtcccaactactcgggaggctgaggcaggagaatggcgtaaacccgggaggcggagcttgcagtgagccgagatcgtgccactgcacgccagcctggggacagagcgagactccatctcaaaaaaaaaaaagaaaagaaaaaaaagaaacacgtgggccgggcgtggtggctgacgcctgcaatccaagcattatgggaggctgaggtgggcggatcacgaggtcaggagtttgagaccagcctggccactatggtgaaaccgcgtctctactaaaaaatacaaaaaactagccaggcgtggtggcgggcgccagtagtcccagcaactcgggaggctgaggcaggagaatcgcttaaacccaggaggcggaggttgcagtgagccgagattgcgccattgcactccagcctggcgacagaacaagactctgtctcaaaaaaaaacttaggggtagagcaatgtctctcaacattttcgttacattagatacaaaactggttaaaaccccacaaggctataaaatgaaaacctttgagatgatctttttctaccagaccgtctacagattttttggacttttttccttaatcacttcctccctcatgaaattttactaccacatacatactgcatatgtttatggactgggctcttttggagggccctagccacagtaatatataagacttttttcacctctcatgaaccgatttttaccaattgaactcatgggttagaagtacaatcatgtgtgtgtctccccagttcctgagaaatgcatccttaggcgatttgtccttgtgcaaatgtcagtgtacttacacacacctgaatggcactgcctgctgcacccctaggccatatggtatagtgtagcctgttgtccccctgggctatatggtgtagcctgttgcccccctaggctatatggtgtagcctgttgcccccctaggctatatggtgtagcctgttgcccgcctaggctatatggtgtagcctgttgcccgcctaggctatatggtgtagcctgttgcccccctaggctatatggtgtagcctgttgccccctaggctatatggtgtagcctgttgcccccctaggctgtgtggtgtagcctgttgcccccctaggctatgtggtgtagcctgttgcccgcctaggctatatggtgtagcctgttgccccctaggctatatggtgtagcctgttgccccctaggctatatggtgtagcctgttgccctctctaggctacaaacctgtacagcaggttactggactgcatactgtaacacaatggttttgtgtatctaaacatagaaaaggtacagtaaaaatatagtattgtaatcttgtgggaccaccatcatatatatgatctatcattgaccaaaacactattatgcaacacttaactgtatacatttaggggtcactgctgaggagttgatagttttggctgtggatatgaggttcacttagaagtgaatgagaagtgagatcctaggaaggaacatgaagtatttactacatatttaaaaggaaagatgcatttggcacaatggtaggaaaatgaggacagtgcacatcctataggtcaaggaagaatatattaaggataaagagattaatagcattgactacttctgagagcttgagtaatatgaaatggaagtggccgggtgtggtggcttacacctataatcccagcacttctggaggctgaggcagatggatcacctgaggtcgggagtttgagactagcctgaccaacatggagaaaccccatctctactaaaaatacaaaattagctgagcatggtggcacatgcctgtaatcccagcttcctgggaggctgaggcaggagaatcacttgcatccgagaggcagagattgtggtgagccgagattgcaccattgcactccagcctgggaaacaagaacgaaactccacctcaaaaaaaaataaatacataaaataaaatcagttggatttagcaatatggaagcgattaagacctgtaggcagaaagagacagaaagcaaattggactgaacacaggaatggatagcataaaccaacacacacaccagagtgcatttgggaggccgaggcgggcggatcacgaggtcaggagttcgagaccagcctggcctatatggtgaaaccccatctgtactaaaaatacaaaaactagccgggcgtggaggcacatggctgtaaacctagctactcaggaggctgaggcagaattgcttgaacccaggagaaggaggttgcagtgagccgagatcacgccactgcaccccagcctgggtgacagagcgagactccgtctcaaaaaaaaaaaaaaaaaaaaaaaaaagggagatatagtcttttttttttttttttggagacaacatctcgctctgtcgcccaggctggagtgcaatggtgcaatcatagctcactgtagcctcgaacttctgggatcaagtgatcctcccacctcactcttccctgtagctgggaccacaggtgcaagccaccatgcccagctaatttatcttttgtagagacaatgtctccctgtgttgcccaggctggtcgcaaagccttggcctcaaggtgtcatactgcctgggcctgctgaagtgttcatattacagaaggaaccaccacgtctggcctacattagctttttaaaagttaattttagaaggtcctgattgaggaatagtttcaatattgaaaagagaaaacgaatcacctatagcaggggtaggcaaactgtggcccctgtttttataaagttttattggaagagtagagccacatgcattaatgtaagcactgtcctggctgtgtatgcactagagcagcagagttagtttcaagagggacagtacgaccaataaagtctaagatattaattacctagttttttacagaaaaagtttgccaagccctgatctccaggtgaggatttcctaaaagccctcaggaatttggaggaaatacaaggtaggaaaaaattggtttattgcaagacagaagaaaggagaaagaataggtgaaggtgaatttgcaatttgttgctcaaaagatgagaaatgttgactgctgggctccttgaaagattgatcatccgaaaatcctgttgatcgaacaaagctttagagctttgacagagtcaggctctctgtcataagcacacaacctgacagtcttatcagtgtgtcagatggagaaagaggggaaagacacagggtctgggttggaaggttcaaagggggtcttgcaggatgtagaactagttggaattggagtttttggacattatgaatgcattttttaaaaatatggatgaaaggctgggcgaagtggctcatgcctgtaatcccagcactttgggaggccaaggtgggtggatcatgaggtcaggagatggagactatcctggctaacatggtgaaaccccatctctattgaaaatacaaaaaattagctgggcacggtggcacatgcctgtaatcccagctactcaggaggcggaggcaggagaatcgcttgaacccaggaggcggaggttgcagtgagctgagatcgcgccactgcactccagcctgggcgacagagtgagactccatctgaaaagaaaaaaaacagatgaaaatgtatagaattatgaccaaaatatttaactaataacttagttattattatgatattcacaaggtaatttcaatatattaattttctctgtcttaaattcaatattcgaagataattagctgttaacaaataacctgcagcctgacgaatatggtgaaatctcatctctataagaatacaaaaattagccagctgtgttggtgggcacctgtaatcccagctacttgggaggctgaggcaggagaatcctttgaactctggagttggaggttgcagtgagccaagatcatgccattgcactccagtctgggcaacagaaaaataaataagtaagtaaataaataaatagatagataaaacttggaaagccctcactacatgggtacattaggaattcctgcactttggagaaagaatgctgataatggtttaacaacgttctctgatttttcagtttgctaccctcgttttttgctattattgttggtctaggtcagggtttgtcagcctcagcactactatgttttgagctgaatgattctttgtgcgtcaggctgcgctgtccatcgcaggatatactgcagcatcactggcctctattcaccagattccggtggcacggctcttctggtgacaactaaaaaattgctccagacatggtctagcttattataaacaattttatttttatgttgtgggttgtatagcaatgtttgatccaaagtatttatcttagcttgaaatttgcagtagctagacatggagatgtctattactgggttttgaacattaattatacatttattgctaaatcatctcacatttccctttatgagtcatcatcatattttcttaaaaaattaggtaagggtttgagagccattgctctgaattcttttttttatttttatttttttgagacagaatcttgctctgttgccaggctggggtgcagtgcagtggtgcaatctcagctcactgcaacctctacctctactgaatcgcttgggttcaagcgattcccctgcctcagcctctcaagtagctgggactacaggggtgcaccacaacctctggctaacattttgtatcttagtagagacagggtttcaccatgttggccacgatggtctcgatctccggacctcgtgatctgccggcctcagcctcccatagtgctgggattacaggcgtgaggcatcgcgctcggtctgctctgaattcttcatcccagtgtttcaaataattgtctcacttccagctcacttatctgacctgaccctgacttttccaatagagccatttcccccaattctccatgtgattcagcaacaagatgtattgtgacttttccaagtgtatatctttaccagaatatacttattcacatcttttttttttttttttttgagacagagtctcactctgttgcctaggctggagtgcagtggtgtgatctcagctcactgcaagctccgcctcttgggttcacgccattctcctgccttagcctcccaagtagctgggactacaggcgcccgccaccatgcccggctaagtttttgtatttttattagagacggggtttcaccatgttagccaggatggtctcaacctcctgacctcatgatccgcatgcctcggcctcccaaaatgcagggattacaggattgagccaccgcgcccggccttattcacatcttttaaaagcacattttgagaattcgaaatggtcaaaaatgtctccccaaaagataggtaagcaagatcctacatcttccttgactcccatgagtcaacagaggcaattttctgacatttgcctttcgttccttcctcctctgcccatcctaaagaacttggcctccatgagccagagcccacctacagagggctgtgtacatgatatgctgcttctattttctgtgggaactgacttgcattttgagaacatttgagtaaaactggaccaccgttccacctagtcatgctcattacaactgatccctgtgcgacaggagtcaaggcggagcttgctttttgatctgatgaccgtctcaatttaattccttctccttgtcactagatatgtaacagcaatgtcactttagaaaaaacaaatcagctctctgagcatcagtttccacatgagtaaaaagattaatgcacactcataggttgttaaaaacattaaaggagataaagcatgatagaacttaaacataaaagtccctatgtagatacttattttctcagcattatacaaccatccctgagcaaggatgtaagagaaggcatttgcctgtagaccaccaaacagagaaagaagagggtgaacaccaggcatcatcggtattacttacctgattcaaaccattacctgtcgggcttcttctaataaatcaaattgttcctatcagaaagagaggtaggccgggtgtggtggctcacacctgtaattccagcactttgggaggctgaggctggtggatctcttgaggtcaggagctcgagaccatcctggccaacatggtgaaaccccgcctctactaaaaatacaaaaattagctgggcgtggtggtgggcacctgtaatcctagctactcgggaggctgaggcaggagaactgcttgaacccggggaggttgtgatgagccaagatcgagccactgtactccagcctgggcgacaagagcgaaatttcgtctcaaaaaaaagaaaaagaaaagaaaatttaaaaatattcacattttccacaactccttcttatccacataaaatatctatataaattattattctctatttggaataaaacactttaggaagtcctgatactcactgtcagtaatggacacctgttccgcatggtggcatgctcatatctaaagtcccgctttcattcctgattatacctgattctgcaaatgttttcagaaatacatcaagttcctaacctagttctaaggaccccagactgtatttcttctctaattccccaagcttacgatgcatatgcattttttctcattagcataggatctccccgttattatcattcatgattcaggttaagtgcaacctcttccactacacacaggtgttgacagttacacaaatgcaaaggctctggatattaaatcaggctcctactcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgctgcagagtgtgatttggtcaacatcacagaacagccgtgttggttccaggtgtgtttcacaataggcatcttctgtgatgttgtgctgtaactgagggctgagccttttggacatcctggtaggggtccctagttgaagactggactgtatgcttctactgaggtatctccctgcactgtgaatgagaaaaaatggtggcttcctttgttttctggagcaggcacacacacttggcaacttcagagtccacgaagatccaaggaaataagtccacgcagacagagcgggtcggcgctctggactcctcaaatccaacaaatttctggcagctgcctgcttggggaaaagacagagttaggccagtgttctaagaccagcgggtttccctcaggtcttctgacaatcttgagcaataggctgaaaattaattacaaggaacagcactcacttacgagtcattcaggggaaaacagtgctctaaaggcatcgcgctaattactgaaggaacttcaggactagagtgaggtaacagagtgcgaaagaggttcgttgatagaattacagaaaaaaaccacaagtatctgaaaaagttattaaaatactttccctttgagagacagggtcttgctctgttgcccagtctagagtacagtggcgtgaccacggctcactgcagcctctggaactcccaggctccagcgatcctcccacctcagcttccggagtagctgggactacagctgggacaaaacacatgcaacagaaggaatggggaagcaaataagggaaaacagctcctctttttttttttttgagacggagtctcgctctgtcacccaggctggagtgcggtggcgcgatctcggctccctgcaagctccgcctcccgggttcccgccattctcctgcctcagcctcccgagtagctgggacttcaggcgcccgccacctcgcccggctaattttttgtatttttgtagtagagacggggtttcaccgtgttagccaggatggtctcgatctcctgacctcgtgatccacccgcctcggcctcccaaagtgctgggattccaggcgtgagccaccgcgcccggccgaaaacggctcttctaagaagccatcaattaaagagatttgcaaaacagtgaagccaaagccactcttctcaataattgtttccgaaataaaatttcaggagtgacgtgacgcgctgcccgcggtctggccgtgagcgccctcgctccttcctctttgactccatcttcgcgggggcggcagccggaaccgcggttcagtcaccaacatgcagttcttggtccgcgccccggagctacacgccctccaggtgaccggccaggagacggtctcccaggtcgcggctcaggcagcgccactggagggcttcgccccggaagatctatcgtgctcctggcaggcgcgtccctgcagggcgaggccaccctggaccagggcgaagtgggaggccccgactgcccgggaggccaagtccgtggttccccggcccgcgctgggaaagtgacaggtcagactcttgctaaggtggccaagcgagaagacaggccgggctgagccgcgggtgcggtaccaccggcgctttgtcgacgttgtgcccatctttggcaagaagaagggccccaatgtccttcttaagtcctttgtaattctggctttctctattaaaaaagccacttagctcgaaaacttttttctcagaaaaatgtttttgtttttattattttattaacttatttatttatttttgagaccgaatctctgtcgcccaggctggagcacagtggcacgatctcagctcactgcaacctccgcctcccgggttcaaccgactctcctgcctcagcctcccgagtagctgggactacaggcgcgtgaaaccacacccagctaattttttgtatttttagtagagacggggtttcaccgtgttggccacactgatctggaactcctgacctcaggttatctgcccgcctcagcctcagtgctgggattacaggtgtgacccaccgtgcctggcttgtttttattattttaaatgaataactataaaatgcagttttaaatttctaatacagtaaacatagatattaacgctcataaacaaaagcttattgggatcttcgtcaataatgagtgcaaaggagtactgattccaaaaagttgagaatcttggcctgaaaaggcatattccccacaaataggactgtgaatgaatgcatccataattttgatatgttttgtcagtttcccaagcacaaaagttgtacaattttgcactccaagcaacaaattaaaaagatgttaaacttttggatcattgcccactggctgggtgagaaatagtgtattcatatattttcaacttccatctgttatattattaatatgtctaagccttttattttcatatgctaaaaaaccattttcacttcttttgctgtgaagtctatgttcaagcctctctctcagtttattccatcaggtttggcctttttggagggaggggtcaattttaagagagagctatagatccaagttcctgtaaattgtgtgagttgcaaatactttctccctccttccttgtttttgatgctctcatcctttcttctgcttaggtctttgaaatccctgctggtttcccgtgtcttaggtccctgaacatgtccgagatgactccactgagtcaccaaaacaaagaaattcaccaactcaaatttttccttgagctctcagcagcagttaacatagctgaccacacccttcttcctagaatgttttcttctctcatctgtctgcagctgacattcctctaacttgtctggtcttgttctccgtggccttttctggtcccacatcctctgaacctctcaatcttggggtgcttcaaggttgagttctggtctcccagtcctggtctctccctaggtaatcttactcgtttctgaagatttaagttccattctccgatttcaatctcctgcccaattcccaacatttttgcaatagaatgtctaaggagcactcaaaattaacatatctaaagccgctcaggatctcaacccagtggctctcttcccccaaactcattcctttagagccacagtttaagccttcctttcaccaattcaactattgttttccaaatttatattctgtcctgccctcctcgtccatctccagctcctctctgctcaaccaccagaatactattttaaaaccaaaaccaagtgagcaggtttgtggtcactttctatggcattagagtaagatcgaagtgggtaataaccccgtcctatacaatctggcctcctgccttcttctgatctctctatagctttcccccatcactgtcaatctagctgcctctaattcatcacagcccttcccccttccgtggccaacagagctcttctctcatatttttgcaattccagctgcctcttctttcttctcttcagttctcagctcaaatgtcttcccaagagagacctttccatcactactcaatttgaaataccttcccactactcatctccttattttattttcttagtagcgaaaagattttatctttctatgaacaagtttacttgtgggtcactctccatccataagaaactaagtccttgagatgccctgtgtctacatctgacatactcgatgcacaataaatattgtaaacgatattttatgttaaaccagtaaaaattgaaggtgtaatgagagagggacagagactaaatatttttacagaaacagcaaaggaaaattgacgaattaagtccccagcatgttgtctacccttattttgtttttcctaatatttttcttcaggctttttcctgataacacacagatacacacacacacacatagattctaagatcaagtttagaaatctaaagaaacaattattaagaaaatgatctatagagaaaatctcacttactttctttgtagcaatcctgggtatttccttttttttttttttttttttttttgagacagggtcttgctctgtcacccaggctggaatgcagtggcgcaatctcggctcactacagcctcgagctcccaggctcaagtgattctcccaccttgacctcctgagtagctgggattacaggcgctgcacgaccacacccggctaatttttgtattttttgtagagacggggtttcagtatttttcccaggctggtcttgaactcctgggctcaagcaatctgcctgcttcagcctcccaaagtactgggattacaggaatgagtcaccacaccgaaccaaggtatttcctttagggaaaaagctggaacagtggagactgaagagattttatctgttcaattcctccctcagccccgccctcacaccatcaggaaggcgtctgtgaagtttcttatcatattcacacaattaatctcattagaaccacctgagtttattaaaacgcaagcctcttcacagggtctctgattccagaaatctacggtggggtccgtaatttacatttttaatggactcccagaaaatgcttaatagccctgaccttggttggataaatatcttgttttatctccagtgccatgtacagtgcctaacacctctagctccttaaggtttggggttttctttcttaatgaatctagtgtatattgacaatttcacaggaaagaagccttcgagctaacactcaagactgtgtttgttccttagtagaaaataatgcctgacttgttagtttctagaacgtttgctggagaagtgttcattccagtatctgtggaaagaaaaaccaagagtagggataactgcctatggaatctgtcacagatgggaggtcagggaacaatcccagataattcatacttgatatttggcttcagtgaggaggaactcttcacagctttctaagttttatagttttgtccccgagggtttttattgcatcagtcagtcaatcccctgctaatcaaaccagggagtttttttctttatgctgctgacaggataatgagaattcttctgctttgcttatctgatctttcagaacctggttctaccttatggaatctcaatacaccgtttctctttttcttttttctttctttttttttttttttagatgagagtctcactctgttgcctaggctggagtgcggtggagcgatctcggctcactgcagcctccgcctcccaggttcaagcaattttcccacttcagcctcccgagtagctgggattataggcgcccaccacacccagctaatttttgtatttttagtggagatggggtttcaccatgttggccaggctggtctcaaactcctgacctcaggtgacccaccctccttggcctccaaaagttctggccaccgcgcctggccatacaccctttctcttatctcagatgattacctacacccactctcttttccaaaacccaattccccagctttcttcaaatagaccacatttattcctgtgccccctcccctcctcagccagtccatcctcctttacttctcttatttttctaatccaatcttcctttctcttctaagcctgggtacggccaacgtctgtgaagatactcacacatacttgttgtcagatactctgtcatttactctcaccatcccttgagctttcataactcttgagcttactcatcttgacaagaaaactttgtaatctttgaatcaaatggaaaataaacatcaagcatattgtcaggttttgaagtctcttaaagcctgttttagagtattaaatgcttaaataaatacttattaaagcctgttttactattaaataaatatttattaataattaaattattaattctagaagagtcaatattttaagataattctaaaaacattacaaaaaagtgtgctaaacccttatttactgttacatgccccacctgttgcatgctccaaccccgtgaggtacatctgcagctgatgaagtagatgacgtagagattaagtcacgggattaagtaattgaccaagagcactgggtgcagaaaattgaagatatggaatttgaatcgggtgccaaatttcatgatatttccttattataattatttgtccttattaaatattaatcaaatggcttgacaatttacaaaaaagatgcctcaaatttgtatgacaatttatcacgagatgctttcatagggctagagtaatcacattacaaggaacacagatcattttaaggtagttagatttttcataggaaaacttttcattaaaatgaaaatcctgaagaaatgtagttttttttcactgtcaaagaacaaatacaattatgaatgagtgagtcattgttctcctgagtcatttcatgaacttataacagtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttttctccaaggctgctccattagaagcaggggcttggctctcactggtttacttcccacagctctaagaggtccagaagtcatgttcaactgcttcttccttgcttaagaaagcattaaaacttaagaatcaggccaggcgcagtggctcacgcctgtaatcccagcactttgagaagccgaggcaggcggatcacctgagttccggagttcgagaccagcctgatcaacatggagaaaccccgtctctactaaaaatacaaaattagccgggcgtgggcgcatgcccagctactcaggaggctgaggcaggagaatcacttgaacccaggaggtggaggttgcagtgagccgagatcgcgccactgcactccagcctgggcaacaagagcaaagctctgtctcaaaaaaaaaaaaaaaaaattaagagtcaaacattatgggggccgggcactgtggctcatgcctgtaatcccagcactttgggaggccgaggcagttggatcacaaggtcaagagatcaagaccatcctggccaacatggtgaaaccttgtctctactaaaaatataaaaattagctgggcatggtggcgggcacctgtaatcccagctacttgggaggctgaggcaggagaatcgtttgaacccggtaggcagaggttgcagtgagccgagatcacagccactgcactccagcctgggcgacagagcaagactctgtttcaaaaaaaaaaaaaaaaaagaatcaaacattatggtcgacctcatgatagcacagttacccatttgttgttgtaagtcagtgcatgcttatctgaacccaacatgttcagtttgcttgcactcttttgtaaggaagataatcctcctaacaattccagcagaattaagaggtcaccttcacctcacctattacaacaccgggacaagccctatcggttttcaccagacagaataccctcagcaaaaggaacgggctggtttaactgaaatcagtgaatcctgagcaaataaacttcggatttttgccaaagttcacaggctgaggaaagcatcatgtctcatggatgaagttagactgacgtgggctctgattccagcttggccacacacttgtcatgacctgcagcaagccactgaacgctgagcatcacttgcaccatgagtcaccgtcaccatcttccacaagtctctgagcattaggagaggttcgatgaaatacacgtaggagcgaggagggtggtaatgagaacagaaattgctctctgaatgagtatgcttcctctcctcacccagagtcattcttttcagcaaagtcaagagcacggccctctacataagggagagtgcagccgggaaggtgatggaggtggtagagatgaattattggcatatgggaaataaagagatctttgatgcccttttcagtttcttttgtttaataatatatatattagtaatgtagtaattgcgtaattgatatcaaggcatatattcagcttttattaatgtaatgtttatctgaaaacttttaggccactggtataatttttttttttttgatactgagtcttgctctgtcactcaggttggagtgcagtggcacgatctcagctcactgcaacctccgcctcctgggttcaagtgattctcccacctcagcctcccgagtagctgagactacaggtgtgtgccaccatgcccagctaatttttgtatttttaatagagacagggtttcaccatattggctaggattgtctcgatctcctgacctcgtgatcgacccaccttgtcctcccaaggtgctgggattacaggtgtgagccaccgtgcccggccactggtataaatttttaggaagaatttttttctgttccattatagtcagtttcaacaataaagcctcattgtcaagatattaaaatcgctgggcatggtggcgcccacctgtagttccagctacttgggaggctaaggtgggaggatctcaagccagagaggtcgaggctgcagtgagctatgattgtgcccctgcactccagcctgggtgacagagtgataccctgtccctaaaataaataagtaataaaaatgtaacaagatactaaaatctacatgctgctcactatcattggaggatatgcatctttacaccctcctgaaagaaggagtcaaaaagcctcctccacactttaaagttatgtgataatctggatacccttcaggacctggacctgtttaaaaagactggcatcaaatgttgtaagggattggatctcagagaaaaaagcagctttataaataaacttgaccagaagttattatgccggcaatattcgttcaaacagaaaatctggccaggcatggtggctcatacctgtaattccagcactttgggaggccaaggtgggcagatcgcctgaggtcaggagatcaagaccagcctggccaacatggtgaaagcctgtctctactaaaaatacaaaaaattagccgggtgtggtggcaggcacctgtagtcccagctactcaggaggctgaggcaggagaatggtgagaacctgggaggcagaggttgcagtgacccaagatcgagccactgcactccagcctaggggatagaacaagattctgcctccaaaaaagagaaaagcaaagaaaagaaaattttatgtcgtcaaaatatttttacaaaaccaggtgttagtcttgcagaacttaatgcagttgagttaatttattcaacctactcaatttagtacacagtagggttgtactactgtgaacatagtttcatagtctgattggaatgaatgaagaaagatggctgagagacaaaataaatcaataaatcagtactatccatcttctctcaaaatataatgcaggaaatccttctccaaatccaccttcaatagtagccctagtagtgatgtaaacaagagtatttcctcagcatactcagtccctttactaaactttacactacgtttcctggctgcgacggcttagcatggatccgttgatcagtattgtcggtgcaatcctggagagacactgcttttttgcttctcttgttaaagtggttaaagtgaatgttaagtagaaaaagggcgtggtttgctagggtgaaagcagcacagagatagaaaacatcagggccaccctgagtaatgcacatttaaatttaaccaggtaggatataaactatggattgcttcttagtcataaagtaccttatataaagaaaatggaggccaggcgcggtggctcatgcctgtaatcccagcactttgggaggccgaggtgggcagattgcctgagctcaggagtttgagaccagcctggccaacatagtgaaaccctgtctctactaaaaatacaaaaaattagctgggcgtggtggcgggtgcctgtaatcccagctactcgggagactgaggcaggagaatcacttgaacccgggaggcagaggttgcagtgagctgagatcgctccactccactccagcctgggcgacagagtgagactccatctcaaaaataaataaattaataaattaaaaaaaaaaaaagaaagaaaatggaaacagccaggcacggtggctcacgcctgaaatcccagcattttgggaggctgaggagggcggatcacctgaggcagggagttcaagaccagcctgaccaatatggagaaatcctggctctactaaaagcacaaaatttgctgggcttggtggtgcatgcctgtaatcccagctactcgggaggctgagacaggagaatcgcttcaacctgggaggtggaggttgcagtgagctgagatcgtgtcattgcactccagcctgggcaataagacaaaactctgtctcaaaaaaaaaaaaaaaaaaaaaaaagagaagaaaagaaaaaaagaaaatggatacaaacatgaagttatagaaaagtagtggagatcatgtagtaaagtaaaaagatcttatggatataactctttgggaaaagttataaacacaaatattttagtaaacattgtaagactaaactagctaatgcaaaagactgttttctaagattcggaagtttacacgggatacatctacctaggcctagtgtgctttctcaggttttgtttctttaaaaacttaataattctcttggtattatattctcaaaaaaattgtctgcaaatgattttagctgagcatccctcttgcaggtagaagaaggataaatctgacagaaacatccatgggctgtatgtagtaatcacagttcgtgtgtgtgcatgtgaataaaatatgtttctttcacattattaaatcgttttttcttttgaaatgaagtcttgctcttgtcccccaggctggagtgcaatggcgtgccctcggctcactgcaacctctgcctcccaggttcaagcgattctcctgcctcagcctcctgagtagctgggactacaggcgcccgccaccacgcccgctaattttttgtatttttagtagagacggggtttcaccatgttggccaggctggtctcgatctcctgacctcatgatccgcccacctcggcctcctaaggtgctgggattataggcgtgagccaccgcgcccggcccacattattaaatcttaatatttatatcatttccactagtgtagatgctaacttaaatgcttggtcttgatctctgatcattaccaagtcaatatatctaatacttaaaattaatgtttttccctctgttgctgaggctggagagcagtggcaccaacacggctgactgcggctttgacatcctgggttcaagcaatcctctcaccggagcctcctaagtagagacacacgccattgcacctggctattttttcacaaagttttttgtagagacagagtctggctttgtttctcaggctggtcgcaaactcctggcctcaagtaatcctccccgccaaagtactgggatcacaggcgtgagccacggcgctggccctgttagaacatagagctagctttgtcaatgctttttcatcagtagtaggtagaatgtagggactggttaaatgttacggtgattacaatcttgaaagaaagtaagtggtatcattactgccaaataacttcttctttagcctgtaactatttcagtgcgcattatgattgtaactagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaaagaagacaggatgcagagttctaatggcacaattggcaaacagagtaggaggcagtctctaatagcatcataaacgaaaacagcccccaaatacctaggaagagctcttccttgtctgtaacaagctttgtttgaggaactaatagtaaagaatgtggttacagaaaatacagtggtgtctgccaagcacctcggcaaatacaaatccacactggagaaagagacgactttgtcttccgagatacctgcctgactcctactgctcagccacgcttctctcccacacgcacccccagtaatgactccagaggtcaagttctgagttctcacgatggcaggagaatcagcctgtcaagacggtcacctcgattaaccacacactgcaaatctgaggactccgtgagggaagggctctgttcctatccagggtttaggcactgggattagagttctccagaaagacacaatcagtaggataggtagagagatgcatgagaggaggtgtattaggggaactggcttatgctattaggaggctgataagtcccaggatgcgacacaccctggtgtgtcagctggagggtgtgtctccagccggagaccagccacgtgtgaaggccttagagccagggaggccgatggtggggctcgtggccagggctgaagccctgcaaaccccggctgctgctggtgtaagtcctggggcccaaaggcctgggaaccccgagttctggtgaacaaggacaggagaggaagagggcctgcatcccaccacagaagatggacacacagattcagtgcccacccgattgagggtagatcttccccatcccctccagtgtgactctcaccctcatcttttccagaaacactttcacagacacaccccaaataatgctttcccaggtttctaggcattccttaattcagccaagttgacacctaaaatcagtcgtcacaatgcgggggaaaaaagcatagcccccaccacagcaatgtatagacatgtcattatgttctcgccaacaggttctaccacaaagtttttgtgccactttgtagagtcctttttttcttttttcttttttttaagacagcgtccaggctggagtgcagtggcatgatcttggctgactgcaacctccacctcccaggttcaagcggttctcctgcctcagcctcccaagtagttgggctaaaggcgcctgccaccatgcccggctaattttttgtatttttagtagagacagggtttcaccatgttgggcaggctggtctcaaactcctgacctcagggatccacttgccttagcctcccagagtgctgggtttactacaggcgtgagccaccacgcctggtcactctgtagagtctcaaagagagagggtgtacccttctcctcttgagcctggcttcaatgtaaacataatgatagaaactgggtcatcagatatcctgtaggacggaggctgtatgtgtcgaagaaacgagagtcgaggtccctgaattcattctgcctactgggtattaaatgaggaaaataaacttccacccgttttaagccactgttactttgctttttactgtcacacatagctgaagctagtacattggatacattgactgtcctaaagttaagatctggaagatctaacatggacagctgagcatgggatttatttgagtttgggataactcatgggatcattctgagttttttggcagtgatggcgaggggaggtggcttaggaacaggagataaagctatggaaaaagcagtgttaatcgtggaggaggactcagactgtctctgccttctagactatgtggctttaataatgaagagctgcaacataaaacctgcgaaccaaaagcattttcttgaaactgatagttcctgaaaagagagaggatagaaggaaaccgctatttctatctaagtcctgtgtcccatggacagtttcatttgattttaatcctgtatgggtaagccttggtcttttcccttgactgctccaagcttggaggtgcagtacagtgatagaacagccgtgaatccaggccagctcgcctgcgccactgctgacttcgcctgaaaattctctcatccattcttaccatcttgctgcatgctcaggccttctcaaaaccaccttggggacgttcttcatcttggaatggtgcctgtgaacaaagatggagttattctgtttaggtaatgctaagaaaaaaatttgttttccttactcccttccctcactggatacctgcagtaagtaggccatcccttagacacaggcagatagagaagaggcactgtggtgggcagaaatatgagaatgcccccaggattctcacccactagtacacatacactttctcccagtttttcaaacacatactaatctgggtgctggccaggagcggtggctcatgtctgtaatcccagcactttgggaggccgaggcgggcggatcacaaggtcaagagatcaagaccaccctggccaacatggtgaaaccccgtctctactaacctccaaaaattagccaggcatagtggcgtgcacctataatcccaggtactcaggaggctgaggcaggagaatcgcttgaacctggaaggaggtggaggttgcagtgagccgaaatcacaccactgcactccagcctgggcaacagagtgacagagtgagactatctctcaaaaaaaaaaaaaaaaaaaaaaaatctggttgttgatgtgagggattttgcagatgtaattaaggccaaatcaattgaccttaaggtagggagactgccctggataggcctgacctactcctgtgagcccccaacaaagactgggtttttgtggtgaggaagacacaatgtgagggattggtggcttgggagaaggattctggagagacacacggcggggatctgacagtggcggacagtggcctctgacagcaactctcattgacagtcagcaagaaaatggggtcttcatccactcctgtaactttaaggaactgagttctgtcaacgatgtaaatgaacttggaagaagaccccaaacttaaaagaatacatgctgtccaacctctgagaccctgagcagagatcccagtcatgggatgctggatttctggcctgcagaactgtgagctcgtacatgggtgttgttttcagatgctaagtttgtggtcacccgttacaatgcaatagacaactgacgcagacactccactgaactgctcagtgactaaggagataaagaaagaggattagaagtggattcttcaagcaacgcctacatcttatgttgggttcaggaaacaaatcaagccgggcgtggtggctcacacttgtaatcccagcactttgggaggctgaggtgggtggatcacctgaggtcaggagttcgagaccagcctggtcaacatggtgaaaccctgtctctactaaaaatacaaaaattagctgggcatggtggcacatgcctgtaatctcagctattcgggagactgaggcaggagaattgcttgaacctgggaggtggaggttgcggtgagccaagatagcaccactgcactccatcctgggcgacagagtgagactgtatctaaaaaaaaaagaaaacaaatcaagaattctgttctaactcaaaattattttattagaccaaaatgatagcctcaacacaaacctagaatagctttgacacagaacttaacctagaaagaaaatatactcggtgaggattttttcatgagaaagtagtaaattttacccttcccctacaagggtgaaaccctctccctgaaccaaagttctttagaagatacaaagtatttgttttccaaaaattcaccctacttgtcactatacctgttcacacaagacaatgaactaaatgtcttcacatgttcagtgaaatgagcacaaattgctaccagtttcagtagttttacattttattttaagaattttcttattttaagaaaacgtggaatgcttcacgaatttgggtgtcatcctcgcacaggggccttgctaatctctgtatagttccaattttagtttatgtgctgctgaagcgatcatggtttccgtttttttctgaccagattctgcataagagaagcctcctgcaggtattgacagattcttgcattttctttgtttttctccacttcctactcattcacgagaggtttcacgtttgactactggtagttaactgtgtaatccacgtggttgaagttcgttccacgaagttagtggcgtacccgctctcagtcttacagaggctaacaacaggtagtcacagattgttacctgtggctttccactttaaggagataaatccttcttcaaaggaaatccgacacacagcacacacacacgtagttgaaattctcatccagccctttgtttatccagcatctgtttgttgctactctccatatatatgcacagaactgttagaatgcaatttgtggagaaaaataaaatacccacacacacacacacacacacagtcccctcctcttgggccagttattctagactgcaggttgctatgtcagttgaattaaccatgaccagtactaaaaaaaaatacgatatttgggccgggagtggtggcttacacctgtaatctcagcactttgggatgctgaggcgggcaggtcatttgaggtcaggagttcgaaaccagcctggccaacatggtgaaaccctgtctctactaaaaaatattaaaaaattagtcgggcatggtggcacgccccgtaatcccagctactcgggaggctgaagcaggagaatccttggagtgggaggtggaggttgcagtgagccgagattgcaccactgcactcagccaaggcaacagagtgagactccatctcaaaaaaaaagattcagggcactttttctgcagcaaagataaaagtgtttcatcagttgcatgtcccatgtcgtgtaaaactgtgtttcttccagtgggtcgtggtcaatagtatgaaaagcactgacataagggagttacagtctaaggcaagagacaaatggcaacactaaggcattgaaggagagataggaagaactatgagctcttgtatcagagggggaacttaattaaccaaggagacttggaaatgcttcccggaggaagctcaagctgagaagcaataagtggggtagatgccctttaccctgaggtatcttccattaatcctcgcagctcacttctaaaagtagtcatcgttgggcaaatagatgaacgaaagcttgctttcttcttcaaaatgattggtggtttaaaaggaaaactattaccgagtacaaaacaaataaattttttgtttcttctttttttttctttttcctttcttttaatttttttctttgtttcttcttatcatctagaagtgcctttggtctggtcctttcaaaatcttgagggttttgcaaaggttagcattttacatggaggttcccatggctctgtagcagatcttatatcataagtgaatttatataaaggttaggggagccacaagggcagtatttttatacgtagactatctggaaggtttgtatttataaagccaaaccccaaaataggttttcttaaacttttaagtttgtttagagttgttatataattctagtaaattttaccactcaaagacccttatgcttggtctcgtttacaaagctagaccattttatatagtgaggatatagttatcaatgaacgtagtcaatatttttaaatagtttaattgtctgacttgaaaaatatccttcctcagcaagaaattcttttttttttttttaatttgagatggagttttgctcttgttgcccaggctggagtgcagtgacgtgatctcagctcactgcaacctctgcctcctgggttcaagcgattctcctgcctcagcctcctgaggagctgggattacaggcacacgccaccatgccgagctaatttatgtatttttagtagacacagggtttcaccatgttggccaggctggtctcaaactcctgacctcaggtgacccacccgcctcagcctcccaaagtgctgggattacagacatgagccaccgcacccggcccaaaattcttatatgataaatcaaacttataaaaatagtgaacctgatattctgaaacatcacaatgctttgtatatatttaaacctcaacttagaatcacaaatctaaatcaatgactcaattatatgttttacattggagttacttggttatttccatagctgagttctcctaaatatcacaagcaaaactaaatagatttttacatatccaaaagtacgaagactctggttatggtacttctttcagttaaaaggcactagccttctagggaatcactgtcattgggttggacatttcagctgggcgtgaactctaaggcagcagatacccagggtgcttctcctcagcacccaccacggaactgacctcccaccacatgatgctgatgcttcccttcctatgtgattttttggtatttcttttgcagcctgcttgaagtgacataatgaccagatacgtttgtgaggatgctgactgggatttggtcagaggccccggtaggcccactgaattcttaccgtacatcagtgacctcataacctttcaagctttctattcatgaagctcaaaacacccctctcagtaacatacacacatcacttgatagattttgcattttcttggctcttaatatactcaaatgcctttttcatttaaatctagagtttgatctggatgaaataatgcatttttccatatataggcatttctgctacgtgcaatgtattttcctaacaaacaaacaaaaagacaccccactctgccagataatgtattaaaataatagtgcttccgtaagagttagagtggaacactcaatccctatacaactcaaaccagatgcttacaaaatgttaacagcccttaaaaaaaggccacatatagagtcgaggacacataaacttctaacaacgacaaaaacaaaaatacagggtaactattgaatctgctttttttggaagtgaaagttatttgataagaaatttgggaaagggttgaggctgccgagttagggtggccaggacaagaggcacataggaacagcaaaatcagcatctctatgacagagtatctggtcaaactgagccaagaagagtgtggtgtggatggctgtcgtgatctcatcatagcagagagatcaccccactgagggcttgctgccttggctgcgttagtgttctctgccttcgactgctcttacttacaaccaaacttcagtgtgccagggaaaggacatgtttgaatcaacatgattttcttgtcatactaaaacaagtcctttactttgcattatagaaacatgttatttttagccctacagttgatttctaatcctcgtaggacaattcccaaggatgtttaagatctatttgaactttgagtttcacctgccttctataatcatgacagtggagactccccattctacatattctttctggacagttacctgtgatctagtcttcagctaccttctgtatgccagaacttcatctctagtttaggtccctctgttcgtcttcaggctcataaggatgtacatattgatcactggagctctctatccagatattgtgcaggacacctcaaagtcaaggtgtccaagatgaaacatgtacatatatatacaccattctctccccgtgtcaaaggcaaccacatccactcagtttttcaggaatgccagtattgtctaggaaagactatctgcgtcatatttctatagttaattactaagttttagctatctaagactttttttttttttgagatagagtctcactctgtcgcccacgctggagtgcaatggcatgatctcggctcactgcaacctctgcttcctgggttcaagcgattctcctgcctcagcctcctgagtagctgggactacaggtgtgtgccaccacgcctggctcatttttgtatttttagtagagacagggtttcaacatattgcccaggatggtcttgatctcctgaccttgtgattcgcctgcctcagcctcccaaagtgctgggattacaggtgtcagccaccgtgccctgcatgtctaagactttatacaacattaaagtccacttatctctatcccactgccactaccccagcccagcttctagctgagaactgcaaccaaatatcaagttttgtgacagtgtaaactattttgatcccaacctgaagccagtcaaaataaataaataaataaataaaaaataatctttctctgccaatctcttgtttaccactttggtggatatatatttactttggaattaagtacacattttttagatgtgcaaggccctgcctattttctcccaaataacttttgctgatgaggagcttgacttactcctccttccagtcctttctacgtaataatggtgccctctgagccttcttgttccttcaaaccctattaggatggaagaagtgacgcttgagtagaatccttaactatttctttgaaactgtttctggctttggtgctttgtgtactcactacagccattttaccatagtttctagatcatgactgtccagtgacttttctgactcttccatgaggatagtttccttgaggcaagaactcgctatattttctggcctttatatagtttgggtgctcacatttggccaaattggtgtttacactgtggtgaggagaagctgcagcctgtgaccctggactcactgaagactcctcgttaatcaagcggccatccttattcggaagagccccaagcatactcacctgttcatttttctctgccgaggcagttgtccgcttgtgagaccattgccttgtgtagagaattccggatttcttgggcctcattctgaaaaggataacgattatcctctcttggaggttgctatgctagagctataaagtcaaaagtaagcataaatttaggcgtgaattagaatgtggaaattagcattactgtcagtcaaaacggggcttttggggctcctgagtctccgttgttgacaggtcagggatagaaaatgaatgagctagtaggaattgttttgaagaccccacgtcttcaaagacggaaagaatgatcaagaatgaacccctgaaattttctttttttcttttttctttttttttgagacagagtttcattcttgttgcccaggctggagtgcagtggcacaatctcagctcactacaacctctgcctaccggattcaagcgattctcctgcctcagcctcccgagtagctgggattacaggcatgtgccaccacgccaggctaattttgtatttttagtagagacggggtttctccatgttggtcaggctggtctcgaactcccaacttcaggtgatctgcccacctcggcctcccaaagtgctgggactatgggcgtaagccactgctcccagcctgaaattttcagagtagacaatcttaccttgaagatgacttttgccttcccagtgatgaattttgagagagacttgtgttgctgagacagaacacgagtctcacacaggagcatcaactctgtcaacacaagccttcaggctttttgggtgcatctcacatatgctattcttgaaatccattacatgacatctcagatgctttgccatctcagccatcatcccctactgcacagcaaaccttggagccataaccagatgttcctttccatctccctagaggcactcacagcaaggcctgcgtgcacctgcaattacaagtggtttgatcaaatgatgcgaatggatagaacaagtcagctctttcttgaaatctggtagatccaagctagccttcatactttgcagggaggaagagaaggattaaggagagaaaaatcaataaaaacctctcatcttgacctgatttttttgcagcaacaggaatttgtctttaatgtcagctcacgatcacatgccttcatcttctgagtcacactctgactgagtcacacttgccattcttagcctgtatagaagttgtctgggactttcctccctccaccctacacctccctcagaatgttactgtctacccacactcatctgggaactctcatttggaatgaggggagggaggcacagttttgctaagaggcagaataaaagcatgccccgggtgccagcctccagctgcctgggaacccagtctttgtgaggtggttttatttgtgaaagtcgtgattcttaacttcttaacttcattgcatgttagaatcacctgaaaagtgacaacaattctgattctttttttgttttttttagacggagtctcgctccgctgcccaggctggagtgcagtggcgtgatctcagctcactgcaacttctgcctcccaggttcaagtgattctcctgcctcagcctcccgagtagctgggattacaggcatgtgccaccacacccagctaccttttgtattttttagtgaagactgggtttatccatgttgatcaggctggtctcgaacacctgacctcaggtggtctgcctgcctcgacctcccaaaatgcccagattacaggcgtgagccacggtgcctggccttgctggctccttttgaaagccctgtcataaacttacctagaagtaagcgctctcttctctggccttaccaactgcggctacaagtaatcaatgagcatgggaggagtgtccccaggcagcatctggcaccaattattattggatagttcaggggccaggggaacctcagcccatccactgccagggacggacttgacaggatccttgcccagcaagcctccttttggtcacaaaactcaaggagtctggttgccagccaaactccttgagttctgcatttgtggctcattcagttctgtggaaatggcagcatggctctgtggttgatagcctggactctgaaataaggccacctctgggccgggcgcagtggctcacgcctgtaatcccagcactttgggaggctaaggtgggtggatcacaaggtcaggagtttgagaccagcctgaccaacatggagaaactccgtctctattaaaaacaaaaaaaatcagccaggcgtggtggtgggcacctgtaatcccagctactcaggaggctgaggcaggagaatcgctggaacctgggaggcagaggttacagttagcagaggtcgagccactgcactccagcctgggcaacaaagggagaccccatctcaaaaaaaaaaaaaaaaaaaaaaaaaaaggccacctctgtgaatctaagagaactcacataactagagtttgttttctcatctgtaaatggggcaggaactcatgtccacctcacagggtcacatgttgaaagtgttcagaatggtgtctggcaagaattgggtgccattagaacaactagtctcgtttctttccgttaaagatcctattttttgcaggggggtgagaggtagagtcttatggataaatgttaagatttctgggccgggcgcggtggctcacacttgtaatcccagcgctttgggaggccaagacgggtgaatcacaaggtcaggagttcaagaccagcctggccaagatggtgaaaccccgtctctactaaaaatacaaaaattagccgggcatggtggtgggcacctgtcatcccagctactcgggaggctgaggcagggaattgcttgaatctgggaagaggaagttgcagtgagccgagattgcgccactgcactccagcctgggcgacagagagagagtgcctcaaaaaaaaaaaaaaaaaaaagatttccctaagaaaagcaaaaagtggactttctcattaaggaagtggtgtgcacttatagtcccagctacttgggaagctgaggcaggaggatcacttgagcccaggagttcaaggccagcctgggcagcatagcaagactctgtctctacagaaacaaacaaacaaacaaacaaacaaaaaaaacagatgaggaaacaacgtgtatatacttaagcatctgtttccctataaaatactagtttaatgtgggatgattatttatttcctaatatactgggtgtattacaccacctagaacttaaaaggtttttaataattcctgcagaattaagtgatagaagcaagcacagaacaagtgacctttgatctcaagagtttttctaaattaatctgctattattctttaccaatattaaatcctatacacatggtagtaattcaaattatttatctctaataatctcaaaccccagaatctgcattagaatgagggaagaagttaaactataactccttttttttgagacggtgtctcactcttgtcgcccaggctggagtgcaatggcatgatctcggctcactgcaacctctgccccctgggctcaagtgattctcctgcctcagtctcccaagtagctgggattacagatgcctgccaccatgcccggctaatttttctatttttagtagagatggggtttcaccatgttggccaggctggtcttgaactcctgacctcaggtgatccacccaccttagcctcccaaagtgttgggattacaggcgtgagccaccgcgcctggccttagactataactcctaaatgtcaaccaagtgtttaaattcttatttgtcttatttgtttgaactgcttttcaaagtttcctgcccaggctccccaacttacacaatttctttttgacttctcccccatttttttaaatctctttaagagacaagtacataaagcacccagcagaaagcctgaaacaaggaaattttcttcatttaacatttattaaagcaaggggatgaacaatatagcctttattctccagaaacaaacaaagcacctccccctaaatcctcagggaagctacgcagatggaagctctagagagcacctcccagtgtccaagctgggcaactggttgagagtggctgggttccacacaccaggaaacctgtgcagttacagtgcccggaaccttccccacagatatggccccatgtcttgctgtgtaatgttaaaggcgaatattgtcaagctgaattgtgtctttaaatatttcagagataacaagagtgttgcgatttttgtttgtttgtttgtaatattttgactcaccgtcaatcagattacacattttatttctgaaatattcagtgagttttctcactcctaaatagtagcttatctcttcagttgaaatacgtgttagtccgtaaaggtccagatcgaataccatttctcccggaagttttttctaattgttccagcaagaatgtcatgttcccgccactaaaatgccaaagcagttaattaatttaaattctaccactctcagggcacacgtcttttcatttcgtagatttttcttcttcttttgcacgtatatcttctgctcccaaagaagagaaataatttttagtcactttcagcactgagctcattgctctctatataatagaggcgcaatatctaatcgttaaataaataaaagctgccattgaagttgcaaactattaaaaaattttattatatcacagctgaaaccaatcttcagagacaattttatccttaaagctgaggaaaattgcttcattaattggcttactccaagtcacacctcacatttcttagctcctactctattctccaatatttctttactgaaaaaactgctgacaaattatttagaaggtatatgtgtgtgtgtgtgtctgtgtgtgtatttggagacagggtcttgctctgtcacccagggtggaatgaagtgacaatcatagctcactgcagccttgaattcctgagctcaagagatcctcatacctcagcctcccaagtagctgggactataggcacacatcaccactcctagctaaatatatatatatatatatatatatatttatatttagagacagggtttctctatgttgcccaggctggtctcaaacccttggtttcaaactgttcccccactcttcgttttattttttaattttaatttttttattttttttgagatggagtctcactcttgtcgcccaggctggagtgtaatggcacgattccgcctcctgggttcaagcgattctcctgcctcagactcccaagtagctgggattacagatgctcaccaccacgcctggctaatttaaaaattatttttggtagaggcggggtttctccacgttggccaggctggtttcgaactcctgacctcaagtgatcccccaagtgatccgcccaccttggcctcccaaagtgctaggattatgggtatgagccaccgtgcctggcctccccaactcagtttagcaccttctcacttttccctcccccagtccctggaaaccacccttctactttctgcttctgagtttgactatgtcaggtaacttgtagaaggggaatcatgtggtatttgttctctgtgcttgacttatttcatttagtataatgtcctcaaggtccatccatgctgtagcatatgacaggccttccttttcaagactgacttgaatatgtatagtatattcaagagagtatattcaatatagtgcattcaatatatgtattggtatgtgtagatctcattttctttatccattcattcctcgatggacatttaattgtttcctcatctccgctattttttaaattgttttgagacggggtcttactctgttgcccaggctggattgcagtggcactatcacagctcactgcagccttgacatcttgggctcaaatgatcctcccacctcagctggactaaggaccacaagcatggaccactacgcctggctaatttaaaaagaagtttttttgtagagaagggtctggctatgttgcccaggctgaattcctgctctcaagcaatcctcctaccttgaccttccaaagtgctgggattatggcatgagtcaccatgcctggtccctcatctcatagcaattgcccctattttggatttccaccaacggggttccaatttcttcacatcctccccaacttttgttgtctgttttttgtttgttttctgttttttgataatagccatgtaacaggtgagaggtgctctctttgtgattgtagatttgcatttccctgatgattagtgatattgagcatcttttcatatacctgttagcctttctatgtcttctttggagaaatatctgactctttggtccatattgttatctggctattagtttttttgctattcagttatagaagttccttatatatcttgggaattaaccccttatctgacatgtgatttgcaaacagagtcagccctccaaatctatgggatctgcatctgttgattcaatcaaccgtggatcaaaaatattttttaaaagactcattatggggccagtcatggtgggtcacacctgtaatcctagcactttgggaggcggaggtgggaggatggcttcaggccaggagcctgaggtcagcctgggcaacatacaaagaacatatctctacaaataaaataaaataaataaaaactatacaggcatggtggtgtgcacttgttgtcccagcaactcaaaaggctgaggtgggaggatcactgcagccctgggggcctgaagctacaatgagctatgattgcaccactgcattccagcctgggtgacaaactgagaccctgtctcaaaaaaaaaaaattatgttccttaccttgtttaaaaattgttctttctagcacttataactacttaatatatatctgtttttgatcttatgcttctccttactaaaatataaattccatgatggtagagattttcctttattttttcctaatttctcatttataaagaaaaagctggggtgttcatgttatttgtatttctttcacatgtgtggttctttgatcttctgaaaatgttatataatattttataattttatcactcctgtgcctaaaatctctagcaattcccatcgattacagaaagaatttcaaaacttggcgtaacacagaagcctattgtgattggctctctgctcaccctcacctccagcccgactcccacttcgtcaggttctacagtctgccaaaacctctaagttttctatttttgaagtttttttgtatttagaatgttaactatttggatgccacatgcagagtgtgggggaaaaaagcaagagcattaaaaatactttaatacttaaaaataaataataaatgtgaaagtctgcaaatgtaggcttttttgggtcattctctaaacaacacagtataacatcgatttacatagcatttacattgtattaggtattacatgtaatctagagatgatttataagtatacaggaggatgtgcagggttaatgcaaatattatgtcattttttttccgggactggagtatccctgaattttggtatctgcaggaggtcctggaatgagtctcctgcagacgctgaggggccactgcattttctttcgttccgcagaatatgcatcttcacgctgtcgatcgtttcctctgctgtgcaggagctttttggcttgatgtagttccctttgtctgttgttgctttttttgaccatgcttttagtgtcacagtcatgaaattccatacttcttctgtgctttcatctacacaaatacatatgtcaacatctatagcatgacctcttatttttaggaaaaatacacaaatagtggaatataatttttattatttagacaaactatttttgagggcaaaaatttatttccccttaatgtcatataatggatgtcatatcatgttaatgtatgtaaacagatctgctttttaaaaaatgtctatgtagtaagatgaagggctattattttggcctggtgtgatggctcacgcctatagtttcagcgctttgcgaggccatgacaggtggatcacttgaggtcaggagtttgagaccagcctggccaacgtggtgaaactccatctctgctaaaaatacaaaaattagccaggcatggtggtgcacatctgtaatccccagttactcgggaggctgagacatgataatcgcttgagcctgggagccggaggttgcagtgagctgagatcacgccactgcactccagcctgggcgacagagcaagattccgtctcaaaaaaaaaataatagtaataaaagctattattttaagtatacattcatgtaagactgctccataatttcagagtatatatttgacaactgttgcaaattctctttcctagaaatatataaataaggtgaaaaaagcaataaaaaaggaaacatatgagtagaaattcatacttgggaaaaaatagacacactcccccctgcccacgcacacacacatatatcctgtatttatctacctggaatatacttcggtataagttgctgggtagagatcaactgaatttatttttccagatgactccctgactttccctaaactgtgtgttgagtaacctatcttttccagactggcatgaaatgacagatatacagaggacccttgaacaacctgggtttgaactcctcaacatggacacttatacacggatttttctcaataaaagtgacaccaagaatgcctgcctctcctgctcagccttccacttcctctacctatctggcctctgccacccctgagacagcgagaccagccctcccacccccacctcctcctcctcagcctactcaaagtggtaacgacaagggtgaagacctttatgaggatccgctttcacttagtgaatagattttctcgtaataacattttcttttctctagcttatttgataagaataaaataatacatgtaacaaaaaaatatattaattgactgtttctgttattgataaggcttggtcaacagtagactattagtagttaatgttctaggaaagttaaagtgtatttttgactgtgcaaggggtcagcacctgtaacccctgcattgctcaagggtcaattgtatttttttaatctcgctctgtgcccaggctggagtgcaccggtgatcatgtctcactgctggcttcgtctcctgggttcaagtgattctcgtgcctcagcgccgagtagctgggattacaggcacccgccatcacgcccggctaatttttgtatttttgtagagacagggtttcaccatattggccaggctggtcttgaactcctgacctcaggtgatccacctgccttggcctcccaaagtgctgggattactggggtaagccactgggcctggctaactttatttttaaagctaggctttcaagcaatgtatttttcaaataagctcccaactagtccaccgcctcatcaacaaataagcccttactgtatctataaagttcatttttttctgcatgtgccaaccctgatggcatctgggtgatagttgtgacagtgaccctcttggagtactcctagcatcaccctctcaggagagaaaggccagagaagaagctacttgagttgttgatctcagaagccgtgtctggtagtgtgattgggtcatatattttgggaaggctggtctattctatgaatgcatttcatctatgaattaagcccaagcaaaatgttgagaaagatggtaaggaagtctgccttcccaagagtgaatgtggtcagtgatttcagatgcctgtcacaccatcactccataatgacagctgtctgacttccttctcacagcaattggacaatgttcatttttttttttgagatggagtcttgctctgtctcccaggctggagtgcagtggagcgatctcggctctctgcaagctccgcctcccgggttcacgccattctcctgtcttagtctccctagtagctgggactacaggttcccaccaccacatccggctaattttttgtatttttttagtagagatggggtttcaccgtgttagccaggatggtctagatctccggacctcgtgatccacctgccttggcctcccaaaatgctgggattacaggtgtgagccaccgcgcctggcctgcaatgttcattttattgagataactggaaattttcacccactcacaagtcaacaagtggatgcagtatagtgtgttgacaaaagagaaagactgggaggtaggcgctccagtttcctagtcctaatccggcgtatgtggtaagtgagtatcaggagatgaatttaatttattctagcctcagttttcctcagcatctgtagaaggtagttggactatatgatctcttgacttccagctaaatataagactatgattccataataatatagttcctctattcatttataactcattaacagaaaaatcgagccacgtgcaaagaattcttgtagtcatcaatgaataacacgtggttattgtgttacgatgcctataaaataaaaaaaattatctggaagagggaaacgggatagagcagatcagtgtgacttgaacagagactatgccagcctccctattccaaattggaatactggctctgtgatgtgctataactgtattgtgaggcttattctaatgattttggtaaatgttaaagactcctcctggggttgtgttgaaataacacactgaatggagatggtagttcataaattctttttctagtggtggcagttagtgttattgtagtctttttttttttttttttttttttttgagatgggatctttctctgtctcccaagctggagtgcagtggtgggatcttggctcactgcaacctccacctcttgggttcaagtgattctcctgcctcagcctcccaagtagctgggattacaggcgtgcaacaccacacccagctatttttactttttttttttttttttttgagacagagtttcgcttttgttgcccaggctggagtgcaatggcgtgatctcacctcactgcaacctccacctcctgggttcaagcaattcttctgtctcagcctcctgactagctgggattacaggcatgtgccaccatgcccggctaattttgtatttttagtagagacggagtttctccatgttggccaggctggtctcgaactcccgacctcaagtgatctgcctgcctcagcctcccaaagtgctgggattacaggcatgaaccactgcacccggcctaattttcatatttttagtagagacggagtttcaccatgttggccaggctggtcttaaactcctgacctcaagtgatccacccacctcggcctcccaaactgctgggattacagatgtgagcaaccgcgcctggccaaactttttttctttttttttttaagactcttacaagactaactcatagcaatattctgaagctgtgacaagttagtatcctggaggctatcttggtagaggtttcatgatgccaccctgatgccacctctcttcctctttacagtagtataactctttgctcttattttttcatagcttaaattctcatcctagcaattcacgtatgctttacaagggatgtataggattgaaacattttgaattaatgatttcagaaaggtgagttttgactaggagaaaggaaggtggaggaaaaaacattctcagccagaaaacttctttttcccaaagttcaagataagaaaacatccaacatcctgttggaggtaagtgggaaagaagtagcagttggagccttgaaagtcagaaaccaatgaacggaacagcctgagtaatggacccgactcgtggaaggctgccaagctggagagtgaggggacggagacagaaatatggcgtgatgagttcgtgggaaggtcaaactcgctggcctttgaggaagagcttttgaggtgcaacttcctggcatgcagtgagcagaaggcaggccaggacaggagctgactcccgagcaggggacacagtgaatttgtggcatttgttaccaatctcggagttcactgtgcacagtctccacactaggcatttactttttcatatgtccgaaaaaatgtctgcacacttcatttctgtccagtaagaactgataatcagggatttgaaggggcctagtttggaaattttcaatgggtgaaaataagtgagcaaaattacatttatactaaaatataattctttccatctgctccatagtgggatagcctcttgaggcaacttccaattagaatgtcattttagatgctttccaagatggcagatgggtgagtactagggtgtgcagggaagatcaataaacagctctggcaattcatcgtgcgcctaacaccaaggaatacttcagtggaagagctctcattttgttgggatgaataaaattaaataaaagtacacagtacccaataaaggaacaaaagcttaggctttggtcaagcagaacaaaaggggctaatgagaaaaggactatgtattacagttttcttctctcagttctcaactaggttttattagtggagttcccaaaagatttggaccaaatttccaattcagatattattagagatcatcaaaactcaaatctctttactggtttacaccaaatcacccaagcttccagcctaaaacccacatgctcacatggttccacagtgctgtttatgtacaataaccagttctcaaaatggtaatcctgttagaagccagaatcctcagcctctagcatgtgtgcttttcacagagataagtctcaaagtttggggttggtgaggagcccagtatacaggagttccacattaagtcataattggctttgtgttggacagtgtatgtcagctggtgaaatcaggcacagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagtaagacagctgctcagcatgaaccccacgactcatcgcagctaactccgttagctttcctgacgtttcctaacgtcctctgtgggggacagtcacgagggcccatctgagcaccacatcacaaactggcgtgggtccagtttacacccttttttttccctttttttgtttttgagacagagttttgctctgttgcccaggctggagtgcagcagtgcgatctcagtcactgcaacctccgcctcccaggttcacgccattctcctgcctcagcctccccagtagctgggactacagtcacccaccaccacgcccggctaattttttgtatttttaatagagacggggtttcaccatgttggccaggctggtcttgaactcctgacctcaggtgatccgcctgcctcggcctcccaaagtgctgggattacaggcgtgaggcgccgcacccagcctgccctttgttttagaggcctaggactgcgcagttactggtcttcaaagccccttcatgacctgggactctgctcatttgccagaaagggtttgtttctattgcaggagaaactccaggaaatcctgaatcttttgcgtgtaaggagaaaggaagctcaggctgtactaacccatgagaaggagagagtgaaactgtgccaggtcggtgtctgtctgacttttgctgcttgtatatgaccccataagggggactaaagggaaatttagtgaaatatcaggaaaaaaaaaagacaaatttttccagtctcacctctaaaatatgcagtttccttgcattgggctgccttcttctgagcgtcctcgtgggagtctcaaggctcagctgcaattcgccccctctaggagcctcctttgcataactagacaacgctgtggcttcctctatgatggctctggtagaattatttaaaacacaagtgatacttatagacatgtaacatgagacggaaagcgattttaaaaagaaatatctcaaaaacatggaggggaaaatgcaaattaaaaaaaataaagagacagagatataaaagcaaaatagtggtttaaatgatacctgacaagtcctcaaggttggtcacggacttggatttgagctctccagcagtcaaagcaaaggactaaatatcaaattatatattttttaaaaccatgtatctgattctcccaatagactttgaaatctgtttttttttttttttttttggagatggagtctctctctgtcgcccaggctggagtgcagtggcgcgatcccggctcactgcaacctccacctcccgggttcaagtgattctcctgcctcagccttctgagtagctgggattacagacgtgtgccaccatgcccagctaattttgtatatttgtggagatggggttttaccatgttagccaggctgatctcgaactcccgacctcaggtaatccacctgtctcggtctcccaaagtgctgggattacaggtgtgagccaccgtgcttggccgtagactttgaattcttaagtgagagtatttgccatgtatgtttctgttcctttttggttatctgacacctactttcattgaataaatatttgttgaataaatgaacacacatttttcataatttttcttaattttgttttatttgtatcatagtcctgatcactacttgtcatatttcttactcatttttggttttctccactagaacgaccgcctcctgggaatggagattttggttttgtttactattgtatctatagcgcacatacctccgaaaacatcaacctctacacccagcgcatcaacagattaaatgtattatatgttggatttcaggaattgttgccatgaaactctaggacttggccaggcatggtggcccacacctgtaatcccagcactttgggaggctgaggagggtgggtcacccggtcaagagacttgagacaatcctgaccaacatggtgaaaccccatctttactaaaaatacaaaaattagctgggcgtggtggcacactcctagactatagtcccagctactcaggaggctgaggcaggagaatcatttgaactcaggaggcagaggttgcagtgagccgagattgcgccactgcacttcagactggcgacagagtgagactccatctcaaaaaaaaaaaaaaaaagaaagaaagaaactctaggacttgtaaggattaaaaatctacagacaagggcatttctcttactaactttatctcgtgtgtgtgtgtgtgtgtgtgtgtgtgtgtgtgtgttttggcaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggtgagaataacattcatgagagtaatgggaaaaattatagtaactcatagtacttcaagccataggaaataatgttttctttattcatcttaaaaactaagttctggtccaaaagtagttttcctaaagaattgacattctatatgtcaataaagccttatagaagagagagagagagaaaaaaaaaaacacatccagaggaataactatcccaaacaagcctgagagtggcttcaatttcttctgtacctgcctctctgcaacctcagctttgttaatttttttttctagtttattaatgtgtatttactatgtgctgggcacattaaatttaatcttcacaaagacctgatgaagataagtaccattatgatatgaactctaggtctagatgactgtcatctacaggatgggttaatagcggcactgatttaattattcatacctgtggtactaacgagatctgcccgcctgatagttaatagacaggagagccctcctgttctgtgcagggagctcctatttctcaccacctttggtctactgcccttctaggctgctgcattcttcaggacctttttttttttttttgagacagagtctcgcactgtcgcccaggctggagtgcagtggtgcaatcttggctcactgcaatctacgcctcctgggttcaagcaattctcttgcctcagcctcccaagtagctgggattacaggcgtgtgccaccatgcccagctaagttttgtatttttagtagagacggggtttcacaatgttggccaggatggtctctatctcttgaccttgtgatccatccaccttggcctcccaaaaggctgggattacaggcgagagccaccggcacccggccgtggactttcttaaacataagccatgtgatccaactccagcttcaggtctgttttgtagactggttccacagagtgctactatttaatttagtgccttccaaacacaccaccccgacctgacacaggcttggttagcctcagttctcaccagcccattttcctttgttatctctgcctctcactggatgatcgagactaacaggttggcttgtttgcagaacaggttccctggacaaggtgatgatacgagaaaaagaaaaggacaaagtattctctagtcattgtgagaaacaccttgtgttcaccacagcacatccctggaagaaactggggacgcttttctctgctctctgtgctcccactcatggtgtgcttcatgggaagcagattctgtgagctttgcaaggactgtatgcaaaatgaatttcgtctgtgttatgatcaaagcgcaccatgctaacttctttcttttttacccgtaggaagtgagaggagccctggaaaggtaggctttcattctgtgttcagttatgcaagctgcggggcagtggtgctgatggacagttctgagtggggataggaggtctgcgctgttgctgggggagaaatgaggtggactctccagctggagcaggtcacgcggtctgtgccgaggagtgaacctctctgctctcttgcaggagcgagccactcttgcttcagtgtccagaggccaccaccacagagctgagtctgtgccgcatcacgggaatgaaggagatgctaagaaaattcagcagtaagtcagcctgatttgttacccctccggggctcgaagaattaacttcagcataccttcttccagtgtcagacattcacgatctgacacgaggctcctggttaaggaatccgggccagcacggaacaccagggagggctggggccacagaccgtctctgagcgtgagcagagagaagcagtgagacttgactcaggctttatctggctttgttttctgtctaaagggtctttttttttttttctttgagacggagtctcactccgtgtcccgggctggagcgcaggggcgcgatctcggctcactgcaagctccgcttcccgggttcacgccattctcctgcctcagcctcccgagtagctgggactacaggcgcccgccaccacgcctgggtaattttttgtatttttagtacagacggggtttcactgtgttagccaggatggtctcgatctcctgacctcgtgatccgcccgcctcggcctcccaaagtgctgggattacaggcgtgagccactgcgcccagccaatcctagtcctttctttgttggttttgtcattgtcttttccatcccccccttgcacgtgcagacacgcccccctcatgcaggggcgtctacatttctagctctgatcccgttaggatgaaagctgacttaaattctaaaatcccagtgagggtgcattcaacgaactgtccttgtagaatgctccagatgtttagtccagccaacactgagagacgtcaggattagttctcagcttttatcttgtggacaatctgaccttcagaggaagaggcctaatgagctttgaactccagagtgctgaataaagccctgccatgggccccggcactatgctactgggctctgcgcttacttacaatgataagtaaggcagattttgcctttccttttgtagaattttcaatgaaattgaggaggaaggcattaatcacacagataattagttatggtgggatctggtctataaataaaagtatgaaatggtatgattggggccgggtgcggtggctcacgcttgtaatcccagcactttgggaggccaaggcgggcagatcacttggggtcaggagttcgagaccagcctggccaacatggtgaaactgcgtctctgctaaaaatacaaaaaaaaattagctgggagtgatggtgggcacctgtaatcccagctactcgggaggcctaggcaggagaatcacttgaacccaggaggtggaggttgcagtgagcagagatggcgccattgcattccagcctgggcgacagagcgagactccgtctcaaaaaaaaaaaaaaaaaaaaaaaaaaaaaaaaaaagtcagaaatggaatgactggggtacctgatcttgtctggacagtgagtggaagttggaatcctcagccaggcatggtggctcatgcctgtaatcccagcactttgggagactgaggtgggtggatcacccgaggtcgggagtttgagaccagcctggccagcatgatgaaaccccatctctactaaaaatacaaaaaactagccgggcgtggtggtggacaagactactactcgggaggctgaggcaagagaatcacttgaacctgggagacgaggttgcagtgagtcaagatcgcgtcattgcagtccaggctgggcaacaagagcaaaactgtctcaggaaaaaaataaaaaaataaaaggaggccccatatgtgactgtcggttcacagactatgtgtgcttcatcacatggtccctgggtgctgcactgaactcacaggaagctgcatttgtcatgacataatgaaaaaggctgattagggattgtgatttgtgatttgaacactcagtaaccgtgtaatcttggtgaagtttcctaaccttcctgaacctgttttcttttttgtaaaaattatagaaaagaatgcttgcagtgattaaatgagataatgtacagaaaatgtttggcacattagaagttcagccaaagataagtgctattttctctcccacccaaactgaagaaccagaacctcccatggctaatatgatgcgaacaaccaagggtgtccctatgtggacgcacagctcggagctctaaagatgtcctgtgaacagagcgacgcccattccacccacagggattctcctccccacctcaggcaggctaaagctccttctccacgtggctcttctctctgtctccatttagagcttcatgctatgtgttgtggaacagtcaaagaagagctcagaaattttgttctcaaccaaatactgtttttttctgaaactgagtcttgctctgtcgcccaggctggagtgcagtggtataatcttggctcactgcaacctccacctcctgggttcaagcaattctcgtgcctcagcctcctgagtagttcggattacaagcacgtgccaccatgcctggctatgttttgtatttttagtagagacggggtttcaccatgttgcccaggctggtcttgaactcctgaccttgtgatctgcctgcctcaccctcccaaagtgctgcattacaggcgcgagccatcacgcccggccccaaattacatttaaaaaaccaggactaaatactaagaattcaatggaaatctcacatacctaagaggtttttcaagcatgcccaagggaaatctcttctttcctcctcttgcagcggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccccatgtgtgtgctggtcactcaaatattgagcccctattaccatgaatcctactgccataggccagattttataaatatatgtcactttttcaagtgtatttaattatttgactcttaaaaactgtgctgctcgaatgtgtctttgtcctccgtgcagagctccgcatgctggggcaacgcaaatccatctggggaaactgaggcatggacacatcttttcagggtgtgtgagagggctcagatctcatccttctcccaaaagccattttccttcccatcccatgagcctgcagtgtttgtactcaggaaggcttatatgttcagaacactgcaaatatttgtgtgaatgtcgtcataccattcatgcttccataatcacaacaggctggaaccttccattaatatgttaaaaggtgacagagcaaagtgtctgttcagtaaatgtatcatgacacgggatgccaagcgactatattgcattgtatataaggttcttttcggtgcttttgtggtttgctgtaagcagaaggctttcaatctccagaaggccaaagagcctaccctcttcttatctcaaaacgtcagggttggccggatgcggtggctcatgcctgtaatcccagcactttgggaggccgaggtgggtggattacctgaggttgggagtttgagaccagcctgaccaacatggagaaaccccttctctactaaaaatacaaaaattagctgggcatgatggcacatgcctgcaatctcaactactcgggaggctgaggcagcagaattgcttgaacccgggcggcggaggttgcagtgagcggagatcattccattgcactccaccctgggcaacaagagtgaaactccatctcaaaaaaaaagaagtcaggttttgtgaggaagtggtggtggctgaggggagctcttttggctggtggtctgcattaggctcgctgtctttagtgatctatccctgcaggtgtttgtttgtttgttttaagatgcaatctcgctctgtcacccaggctggagtgcaatggagcgatcgcagctcactgcaacctccacctccggggttcaagcaattctcctgcctcaacttcccaagtagctgggattacaggcacttgccatcattcccggctagtttttatgtttttgtagaaacagggtttcaccattttggccaggctggtcttgaacccctgacctcaggtgatctgcccatcttggcctcccaaagtgctaggattacaggtgtgagccaccgtgcccaggctttttttttttttttttttttttttttgagacggagtagtcttgctctgtcacccaggctggagtgcagtggcgcgatctcagctcactgcaagttctgcctcctgggttcacgccattctcctgcctcagcctcccgagtagctgggactaaaggcgcccaccaccacgcccggctaagtttttgtatttttttttttagtagagacggggtttcaccgtgttagccaggatggtcttgatctcctgacctcgtgatccacccgcctccacctcccaaagtgctgggattccaggcgtgagcccccgcgcctggcccagcctttgtttttaaatggaatgttcccttgctagtactgcagaatgtccccggtcacagagggtatccctttacctcctctcatctctcagataagccattgtcctaaggcaggcaagacagtggatacgatttaaccaccactccagactgtgttattactaagatgtttaggaaaaatgtttatcagagttttgtctgtaaattggagactcggttggaaagaaattaataattcaacctgttaatcagcacacaaggccttaaaaagaggtctgtgaaataaagagggtttactgtagggtgcgcttatccttctcacccatctgaatctgctttctcttgccactctatacgtttcaatcttgtgtcctcgaaggcaggggagcaaagaagaaacaggctcaagagtctgggaaatgctgtctcctgtgctttgcattcaccatttaattcccaccctgaattcagcatttaattcccaccttgacatcacgcacaatcagagtttgagacttgcagaggggagcccagcacgtcctccttagactatctgtggcccactgtgtttccttcttatttatgtatttatttatttatttgagatggagtctggctctctcgccaggctggaatgcagtggcgccatcttggctcaccgaaacctctaacccctgggttcaaacgattctcctgcctcagcctcccgagtagctgggactacaggtgctcgcgcaccaccatgcccagctaatttttctatttttatagagacagggtttcaccatgttggccaggatggtcttgatctcctgacctcctgatccgcccacctcagcctcccaaagtgttgagattagagacgtgagccaccgcgcccggccttattttatttatttttaaaaattattattattattttttgagacagagttttgctcttttacccagcctggagtgaagtggcatgatctcggctcactgcagcctcctccccacagggttcaagtaattctcctgcctcagcctcctgagtagcttaatccccataggcatgcaccaccacacccagcgaatttttgtatttttaatagagatggggttttgccatgttggccaggctggtcttgaattcctgacctcaagtgatccacccgcctcagcctcccaaagtgctgggattacaggcgtgagccaccgcacctgggccccacttattagacagattttatatcttgatttctcacctcaaaaagctaagaaacaaaatgataaaaagcaaacagcaaccatttggaatacatcttttctcaattaccaaaaatcccagttttgtggagggactaaataaatacaaaagtaatacattttactttgtgggcattacatctcattgtagcataatccagtgatacatcctttcctttccttctttgtcccaaagtggtagatactgacaaagagtctagcctaatttttcctttggcaaaatcatccccagtggctctttgctgcaccattgtgtacacagggcctgccactgatgaggtgtgtggggaagattgaatctataggatcaacctttggagtttgaataaaccaccaagaaaactttgcaagaaaattgccactcacagtttctggatacaaactccaaggtgatgagacgtgggggtgagaaggggagtgagagttgggggtgagaatgggagtgagagttatgggtgagaagggcagtgagagttgggggtgagaaggagagtgagagtgggggtgagaaggggaatgagagtgggggtgagaaggggagcgagagggggggtgagaaggggaatgagagtgggggtgagaaggggaatgagagtggggctgagaaggggagtgagagtgggggtgagaaggggagtgagagtggggctgagaaggggagtgagagtgggggtgagaaggggagtgagagtgggggtgagaaggggagtgagagaggggttgagaaggggagtgagagtgggggtgagaagaggaatgagagtgggggtgagaaggggaatgagagtgggggtgagaaggggagtgagagtgggggtgagaaggggagtgagagtgggggtgagaaggggagtgagagtggggctgagaaggggagtgagagtgggggtgagaaggggaatgagagtgggggtgagagggggagtgagagagggggtgagaagggaagtgagagtgggggttgagaaggggagtgagagagagggtgagaaggggagtgagagtgggggtgagaaggggagtgagagaggggttgagaaggggagtgagagagggggtgagaaggggagtgagagtgggggtgagaaggggagtgagagaggggttgagaaggggagtgagagagggggtgagaaggggagtgagagtgggggtgagaaggggagtgagagtgggggtgagaaggggagtgagagaggggttgagaaggggagtgagagtgggggtgagaaggggattgagagtgggggtgagaaggggagtgagagtgggggtgagaaggggagtgagagaggggttgagaaggggagtgagagtgggggtgagaaggggagtgagaggggttgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagaggggttgagaaggggagtgagagtgggggtgagaaggggagggagaggggttgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagagggggtgagaaggggagtgagagtgggggtgagaaggggagtgagagagggggtgagaaggggagtgagagtgggggtgagaaggggagtgagagagggggtgagaaggggagtgagagtgggggtgagaaggggagtgagagagggggtgagaagggaagtgagagtgggggttgagaaggggagtgagagagagggtgagaaggggagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagtgggggtgagaaggggagtgagagaggggttgagaaggggagtgagagtgggggtgagaaagggagtgagagtgggggtgagaaggggagtgagagaggggttgagaaggggagtgagagaggggttgagaaggggattgagagtgggggtgagaagggaagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagagggggttgagaaggggagtgagagagagggtgagaaggggagtgagagtgggggtgagaagcggagtgagagtgggggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagagagggtgagaaggggagtgagagtgggggtgagaaggggagtgagagaggggttgagaaggggagtgagagtgggggtgagaaggggagtgagagaggggttgagaaggggagtgagagtgggggtgagaaggggagagtgggggtgagaaggggagtgagagtgggggtgagaaggggagtgagagtgggggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagtgggggtgagaaggggagtgagagtgggggtgagaaggggagtgagagggggtgagaaggggagtgagagtgggggtgagaaggggagtgagagtgggggtgagaaggggagtgacagagggtgtgagaagggaagtgagagtgggggtgagaaggggagtgagagagggggtgagaagggaagtgagagtgggggttgagaaggggagtgagagagagggtgagaaggggagtgagagtgggggttgagaaggggaatgagagagagggtgagaaggggagtgagagtgggggtgagaaggggagtgagagtgggggtgagaaggggagtgagagtgggggtgagaaggggagtgagagagagggtgagaagggaagtgagagtgggggttgagaaggggagtgagagagagggtgagaaggggagtgagagaggggttgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagaggggttgagaaggggagtgagagaggggttgagaaggggagtgagagtgggggtgagaagggaagtgagagtgggggttgagaaggggagtgagagagagggtgagaaggggagtgagagtgggggtgagaaggggagtgagagagggggtgagaagggaagtgagagtgggggttgagaaggggagtgagagagagggtgagaaggggagtgagagtgggggtgagaaggggagtgagagtgggggtgagaaggggagtgagagaggggttgagaaggggagtgagagtgggggtgagaaggggagtgagagtgggggtgagaaggggagtgagagtgggggtgagaaggggagtgagagagagggtgagaaggggagtgagagtgggggtgagaaggggagtgagagtgggggtgagaaggggagtgagagaggggttgagaaggggagtgagagtggaccctgggaagtgtgttcccccgtgtagacactcatcccttgcactgctcagggtggggtctcgctgcttcggcctttgacctcgtgataacgacattctttggatatgaaggtgtccccacagaacctgccaccattccttaagctgttccttatcctcccttgttaattcctctccaaatccctgtctttcccccctttcctgaggggcccatttccccgggagatagctattccaagcggaatctgcttctccacctcttcgaacttggctagaagaggtaggaaggacatcaggaggaatcttctgcatcggactgcaatttgctttatttttaaattttcttcctcctggagcactttaaaaataaaatattgccaatctcttatgctgaaatctgatatccaaaacaacttcagataagatctttatctactcttttgctctgattattcccaacttcctggtgtacctccccctgcccctgccacaatcaacctattatgcttggagagtaccggtaccttatctgaccttagattactttacaaggccctcttacactaagtaactgaagaatgtggccaatccagccttctatattcttggatttatccctggcttgtaccttggaaggatgagatccaatacgccaccataggaaaatgaaaaaatgctgaaatgtgcaaaggttaaaataaaaattgcatgcaattttacaacatgcagataaccagtgcttatatttttgtgtatatttttctaaccctttgttttttaatgtatgtatgtttttaacaaaatgaaaaaaaggttaccttaatattacatagtgaacttccttcaatcattagatagttctttaaaatatgaacttttatattcctaaatgtataagcatgtgtcttctacaaattagcacattttattacatttcttatgcaaaaatctacattcaataaatgatacgatattatctaataaacacttcatataaaaatttctcacttgtccttgtaatgttctttatagttgtttttcagtcttccagtaaccagaaataatataggagcatgcattgaatttaattgtctcagaaactatgattttttttttttttttactttttttttttttttgagatggtgtctcactctgttacccaggctggagtgcagtggtgcgatctgggctcactgcaacctctgcctcccaggttcaaacaattctcctgtctcagcctccccagtagctgggactacaggcgcacaccaccatgcctggctcatttttgtattattattattatttttcaatagagactgggtttcaccatattggtcaggcttgtctcgtactcctgacctcaggtgatccacccgcttcggcctcccaaagcactgggggattacaggtgtgagccaccacacccggcctgatttttttttttttttttttgagatggagtcccactctgtcgcccaggctggagtgcaatggcatgatcttggctcactgtaacctccacctcccgggttcaagtgattctcctgcgtcagcctccctagtagctgggtttacaggcacgtgccaccacactcggctaatttttgtatttttagtagagatggggtttcactatgttggccaggctggtcttgaactcctgacctcgtgatccacctgccttggcctcccaaagtgctgggattacaggcatgagccaccacgtccggcagaaaatatgatttttaatgggagtagtatttcattatatgactgtccctaatttatgtaatcattccactattgtgcagcattcagattttctgttggtaactattatacctcccactgtggtgaacacagtgcacataagcccctgggtgtctctctaattcttccccaagtgtgtctccggcaggcaggaaagcttactgtgtgtcctgcaccgtgtgcgtgttggttgtaccctcccttcgttctacctgcactgcaaggcgtcccaaaggcttccctcacacccccacaccgaagggacagacacactagttccagaccagagaaagaccatgtttgcccctgccttgcggtctcaccagagcattgcgtttattccccaagaaactacactgagtggaattggagtagggcttagactttgaaactagacactcaggctgggcgatggctcacacctgtaatcccagcactttgggaggctgaggcgagtggatcacctgagatcaggagttcgagaccagcctgaccaacatggagaaaccccgtctctactaaaaatacaaaaattagccgggtgtggtggtgtggatctgtaatcccagctactcaggaggctgaggcaggagaatcgcttgaacccaggaggcagagattgcggtgagctgagattgcgccattgtactccaccctggacaacaagagcaaaactctgtctcaaaaaaaaaaaaaaaaaaaaaaaggcctggcgcagtggctcacgcctgtaatcccagcactttgggaggccgaggcgggcagatcacgaggtcgagagattgagaccatcctggctaacacagtgaaaccccgtctctactaaaaatacaaaaattagccaggcgtggtggcgcatgcctgtaattccaactacttgggaggctgaggcaggagaatcacttgaacccgggagacagaggttgcagtgagccgagatggcgccactgcactccagcctggtggcagagagagactctgtctcaaaaaaaaaaaaaagaaaaaataatttaaaaattacaaatgataaaattaggcccagtgtcttagagagtatcaaataaataagggcctgaaacttaagtttctctagctccattgtacatctgcctctgggttagccagatacgaagatgaagcacaaaggcagtaaagccaggtctgctgggttcaaatctcagctccaccactcaccacttactaactgtaccagcttgtctccccatgcctcagtcccctcatcaggaaaatgtgtttgaaaataatatccgggccagtacatggtaacctcagcaagttgggaggcccaggcaggaggatcgcttgagccccgctcaagaccagcctgggcaatatagtgagaccccaagtaatactattaccaaaaataaaaagaatgagccaggtatggtggcacacacctgtggtcccagttactaaggaggctgaggtgggagcatcacttaagcctgggaggtcgaggctgcagtgagccgtgattgtgccattgcattccagcctgagcgacagagcgataccctctctcaaaaaaaaaaaaaaaaaaaaaggaaataatactgcttcacagggctgtctagggctgtcgtatgcatgaaatgacataacacttgtacttggagcatcacttaatttcaggtgtaagcactcaacagtgctaactatgaatcgctcctcaccaagcttggacgtctacactagcatgacgctgtttgaggttttagacactgccctgattcctcacagttctgaccaagaacctgaaactgaggtcggaatattgccttctattcctcccatttctgcctgggggtcctggttctgtccttactgtccttacggaaactctacctcaccagttttgcaatggcctctgtggggtcccccagtaacccttctcccctacttcactttctttctgtgccctgaccaagaatcacagagtgtcctgacagctcttcacccagccaggtgcaagcttctcccagcacgcccaaacccaaaccgggcccaaaccggagtctcgaacattcccagacactcattaaggtctcgaggttgtcgcccgaaacacggaaagaaactggccctggcccctaaccaaatttcttaaaactctcacattccataatccctgaacccctcactgcagacacacgcaggtagaacaccttttttttgagatggagtttcactctgtcacccaggctgaagtgcagtggagtggtctcagctcactgcagcctctgcctcccgggttcaagcaattctcgtgtctcagcctcttgagtagctgagattacaggcgcataccaccacgccctgctaatttttgtatttttagtagagacggggtttcaccacgttggccaggctggtcttgaactcctgacctcaggtgatccgcccgcctcagcctcccaaagagctgggattacaggtttgagccactgtgcccagtctctcttttttttttttctggttattatataaatactttttaaaaatgtaatttaattttcagttctggaatgtatgtgcaggacacgcaggtttgttacataggtaaacatgtgccacggtggtttgctgaacctatcaccccgtcatttaggtatttaagccccgcatgtattcactatttatcttgatgttctccctccccctgccccaccgacaggccccagtgtgtgttgttcccctccctgtgtccatacagagcacccctttctctccaaggatcgctgtggcctctgtaagctcccctcataactgctctgaactgagcaccctgctgatgagggcttctttctttggaatcccaatcgaccccatcctggaacagttcagagtactcccttgtgggaattcccccgccgctgcttttggggtgattccagcgttgggttggctggacaaaacagcctcgaagcatactgccccaaatctggtccttctgagtttctgattccctcactcttcatctcttatgacgccttcctaaacattcctgagagtttcaaacattgtctttcatttgactcagggattcatcatccgcttcctgttgaaatagtaaacgcctccacatggactcacgggttcacctccttccggtctgaacagtgaactcctccgcatcaactcacccattcaccccttccggtctaaacagtgaacgcctccgcatggactcacgagttcacctccttccggtctaaacagtgaacgcctccgcatcgactcacgggttcacctccttccggtctgaacagtgaactcctccgcatggactcacgggttcacctccttccggtctgaacagtgaacgcctccgcatcgactcacgggttcacctccttccggtctgaacagtgaactcctccgcatggactcacgggttcacctccttccggtctgaacagtgaactcctccgcatcgactcacgggttcacctccttccggtctgaacagtgaactcctccgcatggactcacgggttcacctccttccggtctgaacagtgaactccgcatcgactcacgcgttcacctccttccggtctaaatggtaaactcctctgcattgtaagtcagtgtctagagtggtgatttgctttctggggtgtgtttttcacagtgatggtggatccacaaatttcaaacaaattctttctccaccagttctgttcggttctattttggtggggcccacgcgtcatcacagagtatctgggagccctgccctcttgcagatgggaatgaaggcccaggtgctctggagaggtgactctcctctaggtgaggggtgtgtgtgtgagaggagtgaggtgcggtgtgggagggtccttgcagggtccggctgctttcggaggctgtttttctcagctccccgttttgtccctccaaattgtgcccctctccttccaattgtcactctcctttcccccaaccctccctgtctcccagttgtctcgcttctcagaaaggaaacactggttctgtaaacctgtttgagaagaaaagctcgaggtttcttggcctctctgcttctggagccaggggaaaaaatagccccaggctgaagacaggagggaccagattgctgcttggtgatgcgatctcactgcagaggcagccaggagaccctcctgagacgaatcggagagtccatgctgcttttacacacatcctagttcttttataactagccttttcctattaacggacatcattcaaaagccagttttaagcaacataaatattgaaaacaatactatactatttagaattaattataagttttgtttttaaagcctaaatcttttattgttgtttgaaccctgggcactgaagctaataatgtaacttttctcccttctttcttctttggcatagatttaaagaactgttagactcatttaaaatgctattaggcattttaaagagtaattgttaaatgtgttgtctcttgtgggactggaaatgttctgttcttatctggcgctggttacatcctgtttttcatttgggaaagtgcattgagctggaaatttatatgttcaatttctgtatgtaaattgtacttcagtaaaaattttcaaaaaagtggctgccttttatagcaggtgtcccatgcgcatatatatatatatatatatatatttttttttttttaagaagatgacctcaagaccaagacctgtttaaaggtggggaaggaagcaggatttggcagagggataagtctagctgccatgcagggacagctacaggctgcctcagccacacacagggcgccctggagctaaattggctctgcaaactagcctggctggagttggactgagatatcctagccgttaggcactcttgggcaaggtggctcccccagccgaggcagttcctgaaggggctgacagctgcagtcagtctatctgcccaggggattcccagcaaaagaggcaaccaattgctgggaggaatctgggacatgcatcaaagtgtccacgttggcctggcgcagtggctcacacccataatcccagcactttgggaggccaaggcggacagacctggagtcaggagttcgagaccttcctggccaacatggagaaaccccgcctctactaaaaatacaaaaattagctgggtatggtggcacgtgcctgtaatcccagctacttgggaggctgaggcaggagtattacttggaccagggaggtggaggttgcagtgagccgagatcgggccactgcactgcagcctgggcaaaagggcgagactccatctcaaaaaaaaaaaaaaaaaaaaagtgtctaccttaattctggagaccaggacttcaggagggaagaggtggagcagagttctgttggcctttcattttaaaactccattttatttatatatttatttatttattgagacagagtctcactctatcacccaggctggagtgcagtggtgcaatctctgctcactgcaacttctgcctcccaggttgaggggattcttgtgcctccgcctcccgaatagctggaatttcaggcacgtgccactatgcccagctaattttttttttttttgtatttttagtagagaatggggttttgccatgttggccaggctggtctcgaactcctgtcctcaagtggtctgcccaccttggcctcccaaagtgctgagattacaggtgtgagccgctgtgcctggcccagcactctgtattatttaatttttaaaaatccatgtaggtggcctggcgcagtggctcatgcctgtaatcccagcactttgggaggctgaggcaggcggatcacgaggtcaggagatcgagaccatcctggctaacacggtgaaaccctgtctctactaaaaacacaaaaaaattagccaggcgtggtggcaggtgcctgtagttccagctactcgggaggctgaggcaggagaatggcgtgaacctgggaggcagagcttgcagtgagctgagatcgcaccactgcactctggcctgggtgacaaagcgagactccgtctcaaaaaaaaaacaactatgtttacatatagagatatatatattatcacatactgaatgtacaaagctgtccttaattcttcaggagttacatacattgctgttgttttttttcttatgagctactataaggaagaggctgagaatgtctttaaaaagagcaggctgtggaagatctagttggtagatcttagttagtattctgctctagaaatcagattctattttatccgcctcttctcatctccaccgcttttatcttccacttcatggataagatcttggctctgtgtttggattcagatgcttatcttttcccagaagcttggccctctggggactgtcatcctgccttcctcccctgatgggtaatggctgatggctgcagctttgtgcttagacgagcagccactgagccaggctgagctgctgctgggcagcctcggtgtgcatatgcaatcaaggcaaagagaatagctatgactgcaagtctcttctatgcatatgtcctttctcgctaataacgatgatgatctcttggataacatatcccagatatttcatgaattctcacatttatgaaacgtctgtaacaggccaagtatgtgtataacagttacactacttttagaagggttaaagaagttgcctaggccgggtgtggtggttcatgcctgtaatcccagtgcttggggaggccaaggcaggaggatcactttaggccaggagttgaagattagcctgggccacatagtgagacctccaattctacaaaaataaaatatattagccggctgttgcggcacatgcctgttggcctagaactcaggaggctgaggagggaggatcacttgaggctaggagttcaagaccagcttgggcaatatagtgagaccctcatctctacaaaaataaaataaattagccggatgtggtggcacatgcctgtagtcgcagctacttgggagggcaggaggaagtcgaggctacagtgagccataattgcgctactgcactccagcctgggtgacagagcaagactgtgtctccataagtaaataaataaccaggccggttgaaacagcatttgaatcaagatggtggtcaatagaatgctgggaaccactgtgttattttaatgatactaaatttgctcatacagaatttctatgagaaaaaaaatcacagggggaaggaataagatgttacaagagacccaatttttttctttctcatgtttcagtttccttcctctttttctccattttgcatttggttgaccagcacagaaaaaaaaatttttttctaaaaagcaaatttataaaagtaaatttatttactttttggggaacaaaatgtagaatcttaaaatggcagcaaagtttagtcataaaacagaatcagtagagtaaaatctcacattcttggttattaattaaccagagggtcccatgagtattgcaagccaagtatcagtgctctggacttgaaataaccaatagttttctcaatagggctgagggtttgccgactgctgattgatattcatcagcaaacccctgacatcctggtgtcaacatcttaggtagcagatgttaacctctggaacattaataaaaggtggtagatcaaggccatactgatgagaaattggggtattatgggaagtcagtcattaagaagaattatccctatagtttataaggatatattttatacatgtttatcattttaccaccttgtgaaaggtcatttttaaaaaagaccaagatggccgggcgtggctcacacctgtaattccagcactttgggaggctgaggcagatggattgtttgagctcaggagttcaagacgagcctgggcaacctggtgaaaccccatctctaccagaaatacaaatattagccaggcgtggtggtgcatgcctgtagtcccagctacttgggaagctgaggcaagagaattgcttgaactcaggaaggagaggttgtagcgaaccgagatcacaccactgcactccatcctgggcaacagagcaagactccgtctcaaaaaaaaaaaaaaaaaaagtctgggtgtggtggctcacccctgtaatcccagcactttgggaggccaaggtgggcagatgatgaggtcaggagttcgaggctagcctggccaacatagtgaaaccccgtttctactaaaaatacaaaaaaattagccaggcatggtggcgcatacctgtagtcccagctagtcgggaggctgaggcaggagaatcacttgaacccaggaggcggaggttgcggtgagctgagatcaggctcaagcctgggcaacagacctagactctgtctcaaaaaataaaaaggaaaaaaaaaaaaagaccaagatgactttcgtctttttcttcttttgagatctacacaggaacagctttgagggctgctgtgcctacacctcagcagagagaaaagaccactgttggagaaagttgttaattaaggaacttattaaatgatagaaacaaaggaaaggaaaacaattttgtcaatttgggccaatgctgacgagctaattattttgctaaccgagattcaaggagaggaaagaaaatcaatgagctgaaaaggcatcttatttaatctaagaaacctattcaaaaaagtttgagaacaaattttcttttctttttttttttttcagacagagtcttgctctgttgcccaggctggagtgcagtggtgtgatctcggctcactgcaacctctgcctcctgggctcaagcaattctcctgcctcagcctcctgagtagctgggattacaggcacccaacaccacacccggctaatttttgtatttttagtagagactagaaatacatgaggttttgccatgttggccaggctggtcaggtcttgaactcctgacctcaagtgatccacccacatcaacctcccaaagtgctgggattacaggtgtgagccaccacgcctggcctaaattttctttttctttttctttcttttttttaatttggtatctcacactgttgtccaggctggagtgcaatggtgcgatcttggctcactgccagctccgcctcccgggttcacacaattctcctgcctcagcttcccaagtagctgggactacaggcacacaccaccaaacctggctaattttttgtatttttagtagagacgaggtttcaccatgttagccaggatggtctcaatctcctgacctcgtgatccacctgccttgggctcccaaagtgctgggattacaggtgtgagccactgcgcccggcctaaattttctttttctgaaagaaataatgaaacctcattaagtcactatgtgctaactggatgttgatgatctcataataggtaaaggccaggtgctataccaaagataaccccaaatagtgtagattaaacagcagaaaactttctctcaggtaacctttcttggtgaattagtggtctctgctccacagagtcattcaggaactgggactagcagagtgtctccgccacacccagcacagggttttaaagtcagcttcagtcatgaccacttcaagctgctagaagctgggcaggtaagggagcctggaagttcagagcgagaggctgttctttctttctttctttccttcttctttccttctttccttctctctttctttcgagttttgctcttgttacccaggctggattgcaatggcgtgatcttggcctactgcaaactccgcttcccgggttcaagcgattcttctgccttagcctcctgagtagctgggattacaggcatgcaccaccatgaccagctaattttgtatttttagcagagacagggtttctccatgttggtcaggctggtgtcaaactcccgacctcaggtgattcgcttgcctcggcctcccaaagtgctagattacaggcgtgagccaccgtgcctggcgagaggctgttctttacccggatgacgcagaagcttcagcatctccttgcctcaggttccactgctcatccggtccaggtgtctgcgaaaatggctaggtattgggtgcagccaagcgctaagaggagagcacatttagggaccccagcaacctctgcagcagctgcactaaaacctcacacacgttacctgcttgacgggaaaaatgctttgaaaagcgtgcaggctttcaattccttatcccccttgggctcaatgtgttttgaaagtcaggaatttttggtttatagaaaagtaacaaattacacgcactctccactgtgtaggaccccagtggggtccgaggcagcaccctttacacaaatcggtcaatattcctggagtgaaacataaaagtattcatacgaagtgggatcagtaaagactaaaagcatcctcctgtcagtgcggggcaggttgtctccgaatacacttttttcccccggattgaggaaaacactttttaggcctggattgataaattgttgataagaaattacggaactgaattaatggtaaaaccatgtaagttaagcatgattgagtaattttaaagcaaaacttctaaagcaattataatgacacaaggtcagataatttttatttaagttctatcctttaaaattatggttctttatatataaatatagtatttgtgtgtatggcaactacaataatgacagggtggcttagaattctaggaataggccatgtgtggtggctcatgcctgtaatcccagcactttgggaggctgaagcaggtggatcacctgaatcaggagatcgagaccagcctggccaatatagtgaaaccccatctctattaaaaatacaaaaattagctgggcgtggtggcgggcgtctgcagtcccagctactcaggaggctgaggcaggagagtcacgcgaacctgggaggcagaggttgcagtgagccgagattgcaccactgcactccagactgggcgacagagtgagactctgtctcaaaaaaaaaaaaaaaaaaaagtctaggaataaaggactaaaagaagtcccacactcaacagcaacacagctaacaaaggtggaaacgatggcccaggaggagagaggatgggcacaggattgggagagtccctgtgtcccctgagcaaaatttctaaaagtagatactgtttaaaagggaggaaatacatttgacattgtggctgtcatgagtgcaagagaaagtggtcagtggatggtgctaggaagcaccattgttctcatccataactgactctcacccagcttaaccccaggacctcttcctataaggctggaaccccactagacctttgcctccaagggccgccctgaactttccttttcctcctttttggaagagaaactcggaaatgcatgcgttttcattcggagcttgctaaccatccctcagtgctctcacatttgggtgctgatttgcgtctctgcacttagcatcacgcaaaatgtagaaatgaccactttttcctgatgcccaagaaaaactggctgagatgcaggagtatccccaaacaggaacttgtgcctgatcaatgtgagcagtgtgaatttggtcctcccgctccggatgagctcagcttcactccagggtcctatgagaagtgagggctggaaaatctctgtgtgagaaacagtatcacttgaggaagtcttaaggcttcttagagcagtttcaggttcgaagcaaaattgagagaaacatagagagatttcccataaactcctgcctctgcacacatgcatcctcccccatgatcacctttgcccactagagtggtacctttgtcagaactgatgagcctacacgggtacatctttattatacagagtccagggttcacactcgggttcacccttgggctcaatgtgtttcaaaagtgctgcacattccttgggtttgaccagtgtataatgacatgcatccaccactatcgtattgtactgagtcgtttctctgccctaaaaatcctctgtgctctacgtattcatccttctctacctagtaacccttggcaaccattgatctctgtaatgtctccatagctttgccttttccaaaacaccatatagttggaatcacacagtatgtcactgacattttttggagcaaggatttagtgactattcctttctactaggatagactgcttccttgcctacatcttctgctgtgagacagcttcacagtcatctccattttgctcttaatgtgggaagagtattcccatttctcaccatctgtccaagaatacccagagatgcctgacaactgaaaacagcttatgtttaatagcttgataggctacgatctgatggcacgactccctaaggaggatctgatcagatcgctcatatgaaaatacattcagttctgctattcacttgttttgaaaatgcaaatttgttccaatgcaattggtgtattggagaacaattcaagcagaatgagaatttcatgtttgtgtatgcatgatttcatccatgaaaaacactaggtgagcagagacaactgcacttagctgaatccagctgcccaggaaggcataaaacagtcacacactcacacacacgcacacgcacagacacccctcaacatctgccagccacctcagttcactgacaatgttatgagccacacccatgcacatttggtgttaacagctttctgtttgatttcctttcttttctgtccctcctgataactctccttctactgcttcagaataactcataagctataatccttctgatgcccacttccacaagcaaacttcagatatttttcaaggtacagtgccatatttattgtagtatttatgtatttcttaaccatttaacaagtgtaaagctgtgctacagtgtttattaggttccttcttttttaatgtgtcagctgacaacgtttctaggtgttgtgcccaggaccccataaacctagtagtttgttgttgtgtttctttatttttttaattaattaattaatttatttttgagacagagtcttgttctgtcgcccggctggactgcagtggcgcgatctcggctcactgcaacctctggctcctgagttcaagctattctcctgcctcagcctcccgagtagctgggactacaggtgcatgccaccatgccctgctaatttttttgtatttttagtagagatggagttttaccatgttggccaggatggtctctatctcttgaccttgtgatccgcccaccttggcatcctaaagtgctgggattacaggcatgagccacgacacccagccaaacccagtagttttttattacacaattctgtagattgcagcgatttttaggaacacatgtggcactccagcagcagaaatgactgtgtatgacaggatgcaaaaatggaattccttttctctaggattccactgagagtctaagatcatttatgtgtcaacttcctcatttgcaaaggagttagaaaaagaatcacttttttatttactcttgcatgggcaagtactaaagttgaagatggaaatttatttggaaattggaggtgctaaagcaaaatatccaggaggccattagcctggggttggttctgtacctggaacacttacacaggcaaaccaaagttcaacttggaagcatttcttgaaactgattattattatttttttgggggggggttgggagtggtgggggggagacaacaaccaataatcagccaatcagaaacagccaactagcaaccagtcacaaccaactagcaaccaatcagtgaactagcaaccattcacaaacaaccaactagcaaccaatcacaaacagccaactagcaaccaatcacaaacagctaagtaacaaccagacaccagcagccaactaatgattaattataaaaagccaaccagcaaccaatcacgagtagcaaaccagtaagcggtcactaacaatcaactagtagtcaatcacaaacggccaactgggaaccaatctcaaacacccagccacaaacagctaattagcaaccaatcacaggcagccaactagtactctatcacaagcagccaactagcaactggtcacacacagccaactagctgttagttatgtaagtagggacttttcacaagatcatactcaaatgaggcctggctggagtcagttgagtaattcctttgttttcatggtcagcctgcaaaagcttgctgttcagtctgctggagcagagctctctgcatctcttctgtgtctgagtgctgcccgattgctgaatgccttaatgctcaaactctgtaaaatttattttgtctaaactttttcctttcatggaaactttctttggaaagagtaacttgagcacctgggtccctaaatctcccttctctgggagaaggatgggtgtactgtcccctcacatcatgcctggtaagaggagctccaggcccctgctacagctgactgtgcgtccatggagcttgtggttacacagtggagcagtgcctgcctcacagctgagaagagccaacaacccggctccagtgatctgaaatacatgaccaacactaaattttgtgtatttgccacaactgcttgaaagaatcatttagaatggtgtcacaggtcctgagaatagagatgatgactgaagagggttgtggacaagatgtaaggacataagtagagggcagagaggacacaagatgccacgctcctggctgtgaagatagggtaagggaccacaagccaagaaatgcaggcagcctctagcggccggaaaaggcatggaaacagctccttcgcttatcttccagaaggaatgcaggactgcctacacctaatcttaatcgagtcaaaataatgtcagacttctgagacctccagaactgcgagataataaatttgtgttgttttaaaaccacagaaggcgtggtgatttgttagcccagctatagaacacttaacacgaatcaagggtggaagcagaggagaaggggaagaagggggaaagaccttcaattcgtcttggaaagtaaggctcacagtcaactgcacactgagtacaaatttacctccagggactgaggccaacctagctcaggaccagggcaaaagcaccttgaagtgctgagaccagtctcatcatatcaccaccaatagcacagggaggctcaattccagcagacacaccctgtgactccattgatgacacagtctgtctgcaattggcaaactcttctttgtctgtgagtaaaatgatgttgtttacaagcaaagttgaaagcatgaaagattttcgataaactcctcagggctcattacaattggaatcaattttatgcactctggtttgggtagcatccttctatgattagagggtggatgccaagcagcctatcgtgttaaaaataggaaaaagactataggattgtctaagcagagtggaaaaacaggctgaaagagttcagtgggtttgtgtaactttgtcttgtaacaaagtcagcaagtgaaaagctagggaaggttttttcctcctcttctgcctcaattttctttttttttctgcctgaatttgaatatagatttcatctatttaaacagaaatacagtctatcctctttgtatactgatctcttgtattccccgcttcttcacttttgtttcttcctcattacttacaagcaggatggaagtcaggtagagccgactgcattccaagtccttcactttctcttcgggtagctgggccctgggtctggcatcttgtgaatgtaaaatgaaggttgccttttgtctggtccttctttcgtataacagatcatagtgattggcactcgtcacacacacatttttattccagagtatagtctcagaaaatcctgctgaaggttcaagccaagaagacacttctatgccaattaatcctaaaaccacccttgcataattataaataatgagagaactctaacatgaccaactccatcttgcttttaaccttaactgctcacttgtttttgttttgcttattatagtagagagaccaataaaactatgagaggaatgtagtcatagttaaacttggagtcaagggaaactgatcccctttcttgtctggagattaaaggtacattcataaaacaaaattagaattatggtaggggattaaacttcgctaaggactaggaagcattaatgacttgccattgcttagtgattattaaactctttctttgctgcaataactgttgttcttgggccaggcagggatggctcatgcctggaatctcagcactgtagcaggccaaggcaggaggatcacttgagcccaggaattggggactagcctgggcaacatagtgagacctcgtttctacaaaaaaattttaaaaattagctggaggctgggcgcaatggctcacacctgtaatcctagcactctgggaggccgatgcaggtggatcacctgaggtcaggactttgaggccagcctggccaacatggtgaaaccctgtctctactaaaaatacaaaaaaaaaaatggccgggtgcagtggctcatgcctgtaatcccagcactttgggaagcttaggcaggcacatcatgaggtcaagagatcgagaccatcctggccaacatggtgaagccccgtctctactaaaactacaaaaattagctgggcacagtggcccctgcctgtagtcccagctactcggcaggctgaggcaggagaatcgcttgaacccaggaagcggaggttgcagtgagccaagatcgcaccactgcactgcagcctggtgacagagtgagactccatctcaaaacaaaacaaaacaacaacaacaagaagaaaaattagctgggtgtggtggggtatgcctgtaatctcagctacttgggaggctgaggcaggagaattgcttgagccgggaggcgaaggttatagtgagccaagatcatgccactgcactccagcctgggcgacatgcaacaagactctgtctcaaaaaaaaaataataataataattagctgggtatggtggtgaatgcctgtagtcccagatatttgggaggctgaggtggaggttgaggctgcagtgagccatgatttcaccactgtactccagcctggatgacagagtgagactctgtctcaaaaataaataaataaattaaataccttccatctcactggctttttcagggaggcagtggaagaacctgtcagtctgtgacaatccctcaatattggctatcagtgacttttatggtctggatggtcaaagagaaaaatggcgccagaaaaacccagcatgtccctatttaattaggaaaaggggaattagtattactgtatgcctactatttgctaggtactgattaaagtgttggttacttagaaatatttcatttctttatcatgttcatagttctaccaaagcgtagatttaattgtcaaatagcacaatctctagcaactggtataacttacgctattaataaatgctaggtctttggaatacgagtggagtttgaaactttattttgctttttagaaagtggtggatttcagacaattttcttaaccttttcaagcctcatttattcaactgaccttttacccagtgtctgcaatggatctaccactggcctgtcctgaaggggtaacagataaaagacaaagtcccttctttgcagagaaaaccattagcctttagtttcttccatgtcaaaatttgaatagtacccattttgcagtgtgttgtgagaatcaaatgagataagtttttatgagagtgcttcacatttagaagaaactcaataaatgttaatttcttgctttccctagcggcagcctagggggaaggaaatttttcagctgggaaacttttatttgtgcttctcaaataatattaacactgccttgggggtgagtggttctgaataacaagcatgggaacaatattagaatgaaggtacctccatggattggtgaaaattgtagtgagattttggtcaatattcaacatttgacagtaaccttattataagaataattctattatattcagttttattgtttggtgagatgtgctgaagcgtaacctcactgatggagacaaagtgagagatagtagtgatttggagtagaattaacagaagtgtgtattactgatcctgggcttattaaatggtctgttacagccaatgcagtaactcctgtaagatgtgctgataagagtagagtaatactgtgaccattcattcgcaaatggtaggaccaaagttctctctttttttttaaatggagtttcgctcatgttgctgaggctggagtgcagtggcgcgatctcagctcactgcaacctccgcctcctgggttcaagcgattctgctgcctcagcctctctagtagctgggactacaggcaagtgcaaccacgcctggttagtttttgtatttttagtagagacggggtttcaccatgttggttaggcttgtctcgaactcctgacctcaagtgatccacctgcctcggcctcccaaagttctgggattacaggtgtgagccaccgggcctgccctggaccaacgttcttctaacaggacgaatatgcttaactcgtatgaaactggactgcagtctgctctaaaggtgtgcctccttctttggcgaatttataaggaagtccccacagccctcaggacagagactgaacaagggatgtgactgctgtgaatactcccagccaaaggccatcaggacacccggagttgaacaaggtaacaaggagaccatcctgtggggacccatggcacgtctcaggaagagggtgacagcacgggcttgtgatggggtttgagcttatgctaggtgattttgagtgagtcatcaatgagacatggtttttctctggtgctgagagcaagcagtggagattctgtgataaaacgttgtaataatttttatctaggaggcaggaggaacacaggagggcttaagctgtaatccacacagaggcagttgttcacgttagcggaagaatgggatgttcaggcagtattatggtttgcaaagtcttgtgttttttttttttttttttttttttttgagatggagttttgctcttgttgccaaggctggagtgcagtggcgctatctcggctcactgcaacctccgcctcctgggttcaagcgactctcttgcctcagccccctaagtagctgggattacaggcatgcgccaccacgcctggctaattttgtgtttttagtagagacggggtttctccatgttggtcagcctgttctcgaactcccaacctcaggtcatctgcccacctcggcctcctaaagtgctgggattacaggcgtgagccaccgtgcccgcccagtgttcttgttttattctgtgctcagacatgtttatggagtggtcttgtttttgtctccctccatcacagtcacagagtgaccctgttgatgctatgctctgtgaaattgtttactttcaccagaacacctggcccagctgtgagcgtcaggccagctcctaccaaatgaatggcaggagctgctctttttcttttgtgtttttcctgccctcaccacatggcctatttccttccagtccagtagaaatgggcagtgactggcccaatagtaggagcccttagccactgacatctggaacaggcttaaggctggtgagtctgcaacactcagcaaggagatagtctgccaaatagcagaaaaaaaggggagaaatggagggattgaacagggagattagagagaaagagaagggtggaaagggagactgggagagagagggagacagagggagagagggagacagagggatagagggagacagaagcagagagagggcccatggagacacgctcctttccaagtctataagcttccttcctttgtttgcaagaaaatgtaaattatataggacttacacgtaggaatgctcttttgaaatccacctattccattcgtgcataattttgtacacttcccttggagtttggtatatgattggccacccagcaatgcaggaggtgcttaagggaccgaaagcgcctctttttttttttttttttgagacagagtcttgctgtgtctcccaggctggagtgcagtggcacaatgttggcttactgcaacctccgtctcccgggttcaagcgattctcctgcctcaccctcttgagtacctgggattacaagcatgcgtcaccatgcctaattttgtatttttagtagaggcggggtttctccatgttggtcaggctggtctccaactcctgacctcagatgatccgtccgccttggtctcccaaagtgctgggattacaggcgtgagccaccgagcctcgtcctaatttttgtatttttagtagagacagggttttgccatgttgaccaggttggtcctgaactcctgacctcaggcaatccgcccgcctcggcctcccaaagtgctgggattacaggcgtgagccaccactcccggctggaaagcacctcttaaacctgaattgggccgggcacagtggctcacgcctgtaatcccagcactttgggaggccaaggcgggcggattgcctgaggtcaggagtttgagaccagcctggccaacacagcaaaaccgtgtctaaactaaaaatacaaaaaattatccgggcgtggtggtgggcgcctgtagtcccagctactcgggaggctgaggcaggagaatggccggaacccgggaggcggagcttgcagtgagccgagatcgcgcccctgcactccagcctgggcgacagagcgagactccgtcttgggaaaaaaaaaaaaaaaggagatgggggcaggaataggcattatgccgggagcagaagggaatgctccctgtagttcagaaaacaaaaccaaacaaaacacactccaacacaaaaaaatgacctgagggcagtcaggatcgaaaagttgagaattttcacaatgttttgtatcctgttggactgtgtttcctgagagaatgataatgaagttttcaatagagggcttagaaatacaaaaattgtttcttgaatacaaatatgtttactaagttgccttaaatatattcatgtatttaaactttattttctgtacctcaatttggtcaccccaaaattaggtttagagtaattttttgagatatgctgtagtggagtgaggagaaaattcgtttggtgctgcctaagagctatcccaatgcagagctttgcaatgagactggaattccatgcaggaagggattctccagccaaacggggtttagaatatgcctcctcctagctcccatcattgctgcaaatctataggaatactgatcacacagagagaaaagaactaactggtagtgtcgccgcagactagagagtttggatgagaaaaggcgggcactgtagggtgcatagcaccgtggaaggaaacactcagtgatacgataatgacagaaagaataggcttgaagcaagtatatatgcaaacactgaaatttgcaggggttagaaattgccctgaaggaagaggtggacaactctgccagacactgggaagatcagtgcggaacacacggccaggatccagccagtcagaactgactcccccatcaatcacatctttgcagaaaaatctacaccagagcttgctagattcctaggttagtgaaaaagattttttcttttttttttttttttggtaactaacattgcaaagtaaacattatatcatgttcattatacataagtaatgatttcagctattgtttgaaatccatggtcaacatcaaaaagcctgtaggttctgttttctaaaactgataggacaagctaagaaaccttacccccatccccttatgcaatcttgaggagtcatgctcagaataaattagatgaaacacttagatgtattagatatgagtcatttctgcttctcaggttgaaagttttttgcatttaaactgtgagaccaagctgaagacaaaaactatctaaatatatcttaatattatgaaaactactattgatatgacaggatcaacctaggatcaacatgctcagaacatttattttaaatttcatgtaactttcttatttgtaatacatcgggcaggtgaatggttcaaaattcaggtacaataagacatacaatgacaagtaaatatttgacttttttttggtactattgagaggtgaaaatgtgctgcctgccctcgctcgctctcagtgcctcctcggcctcagcgtccgctctggccacacttgaggagcccttcagccggctgctgcactgtgggagcccctttctgggatggcctagactggagctggttccctctgcttacggggaggtgtggaggaagaggcgagggcgggaaccggggctgcccgcggcgcccatgggccagcgagggctcggcgggccctgcattcagagcagctggcaggcgccgcccgccccgggcagtgaggggcttagcacccgggccagcagctgcggaaggtgcgccgggtaccccagcactgccggcccacccaggccgcactccaattcttgccgggcctcagctgcctccccgcagggcagggttcaggccctacagcctgccatgcctgagtttcccctccgctgcgggctcctgcgcggcccgagcctgccctacgagcgctgtcccctgctccatggcgccgggtcccatcgactgcccaagggctgagaagtgcaggcgggcggcatgggactaacgggcagctccgcctgctgcctcgccacgggatccactaggcaaagtcaggcaggctcctgagtcaggtggggacttggagaattttatgtctggctggaggattgtctgtgagctaaccagcactctgtgtctagcttaaggttcgtgggtgtgccaatcagcactctgtatctagctaagctcgtggggacttggagaacatttatgtctagctagaagattctaaatgcaccaatcagcactctgtgtctagctcagggattgtaaatgcaccaatcagcaccctgtcaaaatggaccaatcagctttctgtaaaatggaccaatcagctctctgtaaattggaccaatcagctctctgtaaaatgggccaatcagcaggatgtgggaggggtaggataagggaataaaagcaggctgcctgagctaacactcccaacccactggtgttgccttccacatttaagaaagtttgttgtttcattctttgcagtaactcatgatggtgttaactgttggggtctgtactacgtttatcagctgtaacagtcactgctaaggtttgcagtttcctttctgttgccagcgggatcacgagtccaccgggagaaatgaacaactccagacgcgtggtcttaagagctgtaccactcaccatgaagctctgtggcttcacttctgaatccagggaggccacgaacccaccagaaggtagaaactgtgaacccgttcaaacatcagaaggaacgaactggacacgttgttcttaagaagtgtaacactgatcgtgagggtctgtggtttcattcatgaagtcagtgagacgaggaacccaccaattacagacacagtatgatgaaccaaaaaccccaacacttccctgccataaaacaggaatcaaatgaggccagtaacaaagacagtttgagtccagggcactgagtgaaggcactagatatgctgggactcatcattgctttggaacagggacaggatctgggtacgaagtttctaccgctcttgtggtggggagttgggttgggcatcactttcatacggcgagaggaaacggtggtgtcatctatgttagcactggctgcagtggagcttaaaaaacatgttgcaagctctcacatgggttcaagtctgaatttccactgctacgtggtctgaaaactgcaagcaggaatttacatttaaagcacatggagtctatagtatccccaggtacttcagagaagcaaatatcaatactccctcgaggagtaagtcttcaaacaaggcttccaagcaccccacagggttagtggcaccaacttttaactactgtaactaataaggagaagccaagggtacatatgaagaagttgtttatgagcatttgccaacaaaaaaagacctgcaaagacgtcagatactgtaagaacagaatacagaatataaaatgggtattcttaatatgtttcaatgagtaaaggcagaaataaggtgaagagtcaggatgaagggatcaccgaagatgagcagacaaatttgggcaaaactagaaatgtaaactataataattgaagtaaaaagaaaactcaatggaagggttaaaaaattgctggagatgagagaacaattagtaaactcagttattcaaaaattatactattacacaaagagatcaatacattaaaaatagaaaagtttaagagacaagtagaaaatccaccgtacatataatcagaatttgagaggcagattgttgaaaaaaaatgcaaggaataaatttttttttttttttttttttttgagatggtctcaccctgctgcccaggctggagtgcagtggtgtgatctcggctcactgcaagctgtgcctcccaggttcaagcggttctcctgcctcagcctcctgagtagctaggattacaggcacacgccaccacgcccagctaatttttgtatttttagtagagacagggtttcaccatattgtccaggctgggctcgatctcctgcctcggcatcccaaagtgctgggattacaggcgggagccactgcacctggccaaaatatttcaagaagtaatgaccagtgtttctggaatgaatgaaagacccaaatccatcgtgtgtctttcattccatttgatttctcatttggtttttctttttgcagctgggaagtttcagggttattggctcatcatagtaccaaatcatgacagatccaaagaaagacaaataaaagccagtcaatattaggacatattaacagtgcaacagcagaacaacataaacaataagggatcgtgaaagaagagacactttgccaccgggcgtggtaaataagcatatgtaaagatgatgtcaacatcttgtatcaccaagtattacaaatttttaaaaaaggaaatagcactacacacctattaaaaaggggagcaggcagggtgtggtggctcatgcctgtagtcctagcactttgggaggccgaggccggcaggtcacttgaggtcaggagtttgagaccagcctgcccaacatggagaaaccccgtctctactaaaaatacaaaagtattcgggcgtggtggcaggcacctgtaataccagctacctgagaggctgagtcaggagaatcgcttgaacccgggaggcggaggttgtggtgagctgagattgcgccactgcactgcagcctgggcaacaagagccaaactccgtctcaaaaaaaaaaaaaaaaaaaaaaaaaaagggtgagcatcccaaacaccaatgctggcaagaatgtgtagcaataggaactctgattcattgtgctgggagtggatgtactcataaaatggtactgataccatggagggcagttcggtggtttcctataaaactaaacattcttttactacatagtccggccattatgctccttggtatttacccaaatgaacacatcaatgtttatagtagccttatttgtaattgccaaagcttagaagcaactaagatgttgttccttaggttaaaaaagaaaagaaactgtggcacctccagacaataggatattatttagtgctaaaaataaataagctaccaagtgacaacaccacatggaggaatgttaactgcgtataaatgacagaaacaaaaaccaatccgaaaaggtgatgcactgcatgattccagtcatgtgatgcttcggaaaaggcaaaactatggaaatggtaaaaaggtcagtggttgccagaggttaaggataaagagagatgattaggtggagaacagaagatttttaggatagtgaaaccattttgtctgataatataatggtggatatgtgtgattatacatttgttaaaaaccatggaatgtacaaccctaagagagaaccctaatataaaccatgaaatttgaataataatgatgtatcattgcaggtctgtagatttgtcaaatatgcaccactgtcgtgggggatggtagtagtggggtaggttgtgtgtgtatagggaccaagggtatatgagaactctctgtactttctgatcaattttgatgtgaagctaaaactggtctaaaaaataaagtttattaaattacaaaaatctaacagggttaaaaggaaatgggaaaattaatttaaaaatgtatatgggccaggcgcggtggctcatgcctgtaatcctagcactttgggaagctgacacgggcgaatcatgaggtgaagagatcgagatcatcctggccaacatggtgaaaccctgtctctactaaaaatgcaaaaattagccaggcgtgctgcaaggtgcctgtagtcccagctactcgggaggctgaggcaggagaatcacttgaacccgggaggcagaggttgcagtgagccgagatcgcaccaccgcactccagcctgggtgacagaatgaaactccatcttagaaaaaaaaaagaaagaaaaaacatgtatatggcagcataaatatcaagaacaaatgggagaaactcttcaagtggaatgaggtgggaacatatccttcctcagacatcaagacgcattataatccatagactataagacagtggcactagcacaacaatagaccaacagagaaaagaaatttgttagattgtctggaaataacacagtgaaagtgtggaggtttgataagtggtgaaattatcctgtatgtgaatggggataatatgcgctagtccattgaattaatcgtctctctctgactgtttctccctctcactttctttctgtgtgtgtgtgtgtgtgcatacatgagtgtgtgtgcatgcgtgtttgatggggacaggaggcagggaaacgctgggtagaagaaggtggttcttcagcaaaggccccaccttcaagcctggaaactgtggctctaaatgaaaacagttatctctgttttcccgtccaattgttgctttattcaaaaccaccctggcccgccaccctcatgcccctccccccctgaccccgcatcctgtactcataaaacccccaaaccccaggttcaatgagcaggagggcggcacagcagcagagcagcagagcggcagagtggagaaggagagaagagaagtgtctgaacatggggaggagtttggctgggggcggtcatagaagagattcgccatgagatggctgaactccaggggacaatcatcttcccactccatcccctctccacctccccatcccactgagagccacctccacctctcaatgaaatccctgcattcaccattcttcaagtccatgtgacctgattcttcctggaagctagacaggaattcaggattcctgtaccaattccattgggtacaggaaccaaaaagactgtcacgttgactcttcactgagctgttaaacactttagctttccctgggtggcagggctaaaggacattgtaatacccctagccactgctggggggtcagagcccaaatgtgctcaccccagctcacctgtgtgctctccctcccttaaagggtttgaacacgcaccagccgaataaatgagccacatgccatcacatgttccgcgaggggtcagagaactctcctgtttcatgttgacggatgttgtaagcattaatggttttaaatgcaaaaggaaaactcggaaatgttaaagatagtatagaataatttcattatggcctttgaataggaaagtatttctgaaacagcatgtaagatgtacaagccacaaaaacatcttgataaatttgactacattaaaattaaaaacttcttttaatcgaaagatacaataaaaaaagcataagtgatacacatgcagggaaaataatttttttctttttttttttgtgatggagttttgctcttgttgcccacgctggagtacaatggtacgatctcggctcaccgcaacctccctgtcctgggttcaagcgattctccagcctcagcctcccgagtaacggggattacaggcatgcgccaccacacccagctaattttgtatttttagtagagacaaggtttctccatgttggtcaggctggtctcgaactcctgacctcaggtgatccacccgccttggcctcccaaagtgctgggattacaggcaaaagctaccatgcctggcctaattttaaaaaatacatgaaattaatgaagcattatgatccagaatatataaaagtataatatatcagtaaatcaacaaaaatggggaaaagatgtgaaaaaatttcacagtagaggaaataacctgttagaaaaatctgtaaaaggtactaacaagtactttacagaacaggaatataagtggccagtagatatatataaaaagattctcaattcgtaataatcagtaaaaggcaatttaatatttaatgaaatctcatgatacacctaatacataggtaaatatgaccaggatatagaacaaggatgtccctggggcagttgctaagagtgtgaattggtgcaatgactttcaaaatcaatttggcattatcttgtaaactgaatgtgagtatgcccaattctagtatgtgctgtaggaaaaatgtctacccctttgcacaaggaatcatacaaaataatgtttctaggagcattgttaataatagcaaaagacaagaacaaaaccttgcaagtaaccaaatgtctattgggtctatttgtgggaaaatggataaagaaattgaggtttattcatgaattggacactatataatggtgaaaatgaataaacttgaattacacatgtcagggtgatcgaaactcagaaagttaatacattgtggaagcaagttgtggaaagatatgcagcatgatactgtattataaattcaaagccaagcacactaggcagtgtattaacagctgtgcaacacgtatgtgaatggaactcttggagaaaacccagggccagggatgaagtaacagaagcgaacaggagcttcagagataacagtgacgttccatgtcttagtgtgggtgaaggggtcaatggtgtttgtttcatgaaaatctatctctatctgctatctgtctgtctgtctgtctatctatctatctctctatctatctatcttctatctaatcttatctatccatcctatctacagatgtatatgtttgtgtgtatataaatatacatctgtcacaaacattctcttatgtgtatcaaatattttcataataaaaacatttacaaaatctcctactctttctagtcctgttattccatagtttccccttctgtgtcttgttttgtaaacttaatgtgtgggccaggtgcagtggctcacgcctatattcccagcactttgggaggctgaagcgggtggatcacctgaggtcaggagttcgagagcagcctggtccaacatggtgaaaccctgtctctactaaaaatacaaaaattagctgggtgtggttgtgggtgcctgtaatcccagctactcaggaggctgaggcaggagaatcacttgaacttgggaggctgaggttgcagtgagctgaggtggcaccactgcactccagcctgggggacaaagtgagactccatctcaaacaaaaataaaaaaagaaaataaaaaaataaacttaatgtgtggatgttgttccttcccagtatacattattttcctccagctttatttaggtataattgataaattaaaattatatatattcaagtaatacaatatggtaatttgagatatgtttacattgtgaaatgaccacagtcaagttatttaacaatcatcatcacacatagttacctctgtgtgtgtgtgtgtgtgtgtgtgtgtgtgtattatgtgtatgtggttaggacacctaagatctactgtctcagacaatttcaagtattcactgcctccttgtatatatggatgcagtgtatacttgaaattgtctaagagagtagaagctttttatcttctgtctttctttttcttttttttgagacggagtctctctctgtcgcccaggctgaagtgcagtggtgtgatctcggctcactgcaacctccgcctcccaggttcatgccattctcctgcctcagcctccgagtagctgggactcaacgcccggctaattttttgtatttgtagtagagacggggtttcaccgtgttagccaggatggtctctatctcctgacctcttgatccggacccttctgctgttaaagcttgaaacttgtattcattttatctgagttaggtcctcaggaaagaaccttcagtcctctcaaaaaaaagtgtcgaagaactgaaactcaccagatcatatgccttcttgttttcttacacattgttatatttatttcctgctgtataaatccctagttgtagtcagtcagggagaggatttgagactgagctcccatctccttggctgcagcatcccattaaaaacttcttccttggcaatacttgttgattggctttctgtgcagtgagaacaggacctagaccaaatccctggtgttttggcaacaaaatgatgtgtaaaatctctatgcagatagctataaaacattgctcagagaaagaaatactgcacaattttaggtttttttttttttttagatggagtcttgctctgtcgcccaggctggagtacattggtgcaatctcagctcattgcaacccctttctcccaggttcaagcaattctcctgtctcagccatgcaagtagctgggattacaggctcccactatcatgcctggctaatttttgtatttttagtacagatggggttttaccatgttggccaggctgatcttgaactcctgacctcaagtgacccacccaccttggcctcccgaagtgctgagattacaggtatgagccacctcccccagccaggtctttcttaattaattcaaggtggactatatatccaaacataattgctaaaactataaagcttttcaaagaaagcataggagaatatctttgttaccttttagtaggcaaagattgcttacacagaacttgggaagcacacacacacacacacacacacacaaacccagataaattagacttatttggcatgtaattatttactttgaatcatagtacatttatgtactgtaacggaaaagggtctattgtctattcctgaggcactaacttccctttcttatggacgtttaagtctgcaagtgaattttgtatttttcaaaagctattttaaacctttatgcttttccacactaaccctacctttaacccactttcctctgttaatttttttcacttaatgtgtcctagtgattgttcatattactacataaaatttctttgttttcttttttttttttttttttttttgttgagacagggtctctccgtcacccaggctgaagtgcaggaccttggctcaccacaacctccaccttccagttcaagccatcctcttatctcagcctcctaagtagccgggactacaggtgtgcacaaccacgtcgaactaattttttgtatttttggtagagacagggttttgctgtgttgcccaggctggtcttgaactcctgacttcaagcgagctgcccacgtcagcctcccgaagtgagccactgcgcctggtctagtacataaaatttctgtatttgttagttttaattttttcaaagttgtaaatgtacatatttcaaagcctcaagtagttctataaggattaatatgtaaaactgtactactatatttggccaggcatgatggctcacgcctgtaatcccagcactttgggaggctgaggcaggcggatcgtgaggtcaagagattgagaccatcctggccaagatggtgaaaccccgtctctactaaaaatacaaaacattagccaggtgtggtcgtgggcgcctgtaatctcagctacttgggaggctgaggcaggagaattgcttgaacccgggaggcagaggttgcagtgaattgagattgcgccattgcactctagcctgggcaaaaagagagaaactctgtcttaaaaaaaaaaaattaaattgtactatattcatctccttctagttcttattcttcagagacaataattaagctcacatagcttttcttttggtatttaatgtaatcgcatgattttaacgactatactgctagttctgtattttgttgttgttattgagtcctaagcttaactactgacttctcactagatcaaatttattttatttcatcacatttcacatacatttacacattttcatgtaccattctaccaatttacttatatttgttagataagtattcaatatttgtattatgactatataagcatgatttacactacagatatgtagaatatggactttaactctcccaaaagagggctgctaataatttctcccatctttatatgtgtaaagtctattctttcccacatgaatctggactgatcttgtgactagctttttctcagtagaatgtggcagctctaagccttgtccctcagagtcatggcaacttccatgttctgtctttgggagacttatgacagcttgtaagaagtctgactattatcctggacagagaagcccagtcagtcctcagccatgctagctaccacttcagccagggcaccagacaatatgagtggagtggggttttgatggagagctttttcgtgattcacattcctcctttttttttttctttttttcttggactaaggaattcttttttggattgaaagtctaaaatccttgtaactttcatattttattttgtacttcttagaatcatgctctactttttgggagatctaaattttaatttttaattaatttctcggttaagtttttaattacagacatcatatttttctctttttctccaaaataattctcctcttcctccttatccttctagacctatttttctttcagggatgccatatatccttttatttctctgtggacattagtgactattttacagagttttggcttcctgcatagtctcaattttctccaagttacttattattgtttgtttgttctattctatttttaaggtgagaggctgtcttcagttgcctagagacacatggttgtctgctcataattaagattggggtattagtggctgggcgcagtggctcacgcctgtaatctcagcactttgggaggctgagggaggtggatcacctgaggtaaagagactgacaccatcctggccaacacagtgaaaccctttctctactaaaaatgcaaaaattagccgggcctgatggcgcacctgtagtcccagctacttggggaggctgaggcaagagaatcacttgaacctaggaggcagaagttgcagtgagccaagattgcactattgcactccagcctggcgacagagcaagactccattccccccacccctcctaaaaaaaaaagattggggtattagcaaattgattgggcaaggcttaagcctagccccattgcagagagatttagtcaggctgacttgttgaagcctcactatgccagtctctaaattttcttccttggataggtcagatttctcagagaagtagcttcttgtctgcttggaggacaagatcctggatatcaggcaggcattctgcatatcaggtgggggaagaaggctggatacgtgaaattctgtatgtgagcaaaatccagtgtgatccctttctgttaatgtggcatctcaggtcttgtctggtgatcctctgatctacagagaagaaacctccatccagccttctgttggatgacgtgagccaattgctcaaacagaccttcagcttcttggaaacaatcctgtgtttaattgcacttcctaagattcctggagccaaaaattactgagccttttgggaattctgcaagctggttacttctggccttttcctaccactggcttagtatttattatgttcggatttgctcatttaaatattacttccttttttcctttcagaattttggtgctttttatttcttttccaggtttttgttcttgtggggttttatcttcaaaataatccctctgtatcatttcatggtatttttggaaagatttggtatttagacaactatcataaaatgaagtcacctttgtttaatggccttataaaaacattatgctgtgaatatataagaatttacttatccagtcaaatattttgtttttttaagtatgttgttagacaattagaaaatgtcccagttgaagactaagaaatgctatttcaaatttgtgtttattttactatgtgaaccttgagcatatttttattagtttagaaaacatttgtttttcttcacttgatcttagccaaaaggctgagaagaaatgacatttgtttttctttaatgtgaactacctatcatgctttttccctcatttttctgttgaaattttggtgtttctcttctgaaattttatgtcatgtgctattagtaacacataattcctttaggctgactctgagcacactgcctatgagttaacctgctctgcaaggagcagcactgttcagtcaaagctgctgtctaggccgggcgcggtggctcacgcctgtaatcccagcacattgggagcccaagacaggcggatcacctgaggtcacgagttcgagacctgcctggccacatggtgaaaccctactaaaaatatgaaaaaattagccgggcgaggtggcgggcacctgtagtcccagctacttgggagcctgaggcaggcgaatcattggaacccgggaggcaaagcttgcagtgagccgacatcgcatcattgcactccagcctgggcgacagaacgagactccgtctcaaaaaaaaaaaaaaagcctgctgtctgacaccaaaacaatggacatattacagtttggttttggtcttttggcttcacttatgttgtatgcttctgtgtgtttgtaaagtagaactctaataaaatttacttttaacttcttcaaactgaatatttattggatgagaaaattataatatcacttgaaaacgttgtaatgtttcaatagttttcaattttgtctccatattaaaaatgttttctaataacactcctaacatattctgaaataagacatcaataaggagcacacgatcttgtgaacactcatgacgtgatgcaccagcccgttcccttgtctgccccagcttcatgccactgctcctcagtctcctcctcaccccccaggggctcccctctttccgcctttcaggtcctctcagctctttcagaggcgcagagtggtgtagaatgaagattctgtgggggagtcataacttagagtcttccacttgaaacccaaacgaagaagtgtggggagagaaggctggggacagattactggagattgccagtaccctagagtcagggggagcaagaggagcccctgggagatactgaaaaggaatgattacagcagtcagaaaaaaagttgtcaagacagcaccacagaaattaaaaagaagagagttgactgggcgcagtggctcatgtctgtaatcccagcactttgggaggctgaggtgggcagatcacgaggtcaggagatcgagatcatcctgggcaacatggtgaaactctgtctgtactaaatataccaaaattagttgggcatggtggcgtgtgcctgtagtcccagctacttgggaggctgaggtaggagaatcacttgaacccaggaggcagaggtttcagtgagccaagatcacaccactgcactccagcgtggcaacagagtgagactccatctccaaaataaataaaaaataataataaaataaaaagaagagagtttttagaagaatagttggaagaactaacagttttagagatatcagataataataccaccagcagtagtctgctggagaattctatcctgatcagaggagggtcattccttttgttctaaccgggccttcacctgattggatggggtccacctacagtctaaaggataatcctcagagtttattgatttaatggtaatctcaggcaaaaccaccttccaaatagacacacaaaattaactgtcatggagtggtagagaaaaaatgtaccttttcagtgagatgaatagagaaagaaaggggaatggtgcaataaatgagatgatcaattggggaattaagtggactagagaaaaaaacaatactatgccagaagtttttcttttttattattttgttttttaaagatgaatgaaacataagcatgttgttttgctggggagacgcattagcagagatgaagagcaggaaggttttcagggtcgtagtgtcggctgtcacttctgagcctcaattttcgcagattctcacaagaacttctggccctgattcatggatttttgctagctatatctactagtatctcccaccattccatatgcaatacagttaagtttattttttccatttccctttatcaaaaccttcccctaatttcacctttcacatgtctgtcagtgacgtcagtaaacgtccaaaggtctatgaccttgcagaagaaatcacaaacgcacgcgtgaacatgaactgtttccccttaagaactctaccttgttattagccgaccgtggtggcggccgcctgtagtcccagctactcgggaggctgaggcaggagaatggcatgaacccgggaggcggagcttgcagtgagccgagatcgcgccactgcactccagcctgctgggcgacagagcgagactccgtctcaaaaaaaaaaaaaaaaaaaaaaaaaaaaaagaactctgccttgttgattgtacatacttactggaatcttttattttttattaccaggatttgcggtcgcaggtcttttttcctgatcacagtattgatatatcatgagaaccatcaggatagctccctaaggaaaggtttctcaggaggttttgcagagggggagtgattttcatgattcttagcagttcttgaagagagaatgcagaatctcagctccggtattccatggaatctctgttgttttattcgcagagtcgctttgcccatttttcctccttgcatttattagagagaaaggcatctggttatcaccattggcctaaaaagatttagtaattaaggatcttcttaaaattcgcattctatagcattaagatacacagatgagaaggtgtttcatggaaaataaactttgcaagcaaaatataaaaacccatttatagtaggaagaattgtgagtcagctagctatctcaacccttcaaggcacacagagcaccacagaagtgaattacactgaattatccaatatttgaatcttgccgctgattgaaaaatggtaatttttacaacaaaattgactaaataaagtgttgctccatttgtacactggagaatatacagctattatagaaaaggtggaacatctatagagatgctcgtcagccaacagtgggattacttctcagtaaatccattataaattggaaatactgtaagtcaaaaatgcattaggtacccccaagtaacctgacttgatcactacacattctccgcacataacaaagtatcacacgagccccataaatatgtacaaatattatgtatcaataaaaaaatgcctttaatacccctagcctcctgaacatcagcgcttagcctaccttaagtgtgctctgaacactcacagcagctacatctgggcagaagcatctggcaacacagtgcactgcagagtactggctccttacccaggtcatcacatggctgacagggagctgtggctcgttgccaccacacagcattgagagagtattctgcctctttctactgaagcatattgcttttgcatcatcttaaagtcacaaaactgtaagtcaaaccatcatgtcagggaatgtctgcacacattgataaagaaattttcccagggccaagcgtggtggctcacgcctgtaatcccagcactttgggaggcccaggtgggcaggtcaccagttcaggagatcgagaccatcctggccaacatggtgaaacctcgtctctactaaaaaaaaaaaaaaaaaaaaaaatacaaaaattatctgggcatggcagtgcatgcctgtagcctgtattcccagctacttgggaggctgaggcagaagaatcgcttgaacccaggaggcagagcttgcagtgagctgagatcgtgccactgcactccagcctggtgacagagcgagactctgtctaaaaagaaagaaagaaagaaaaatttccaatatccactggaatataaaatgtgcaaaaggcaaaagtacatggtataatatactccatgtactggaaaaatatgttcatacattgaaaagagatttctgaaaaaatgtcctagaaactggcagcagcgcttgtctccaagtagagggaactaggtggctgggatgtggagaaaggcaggaaatctacttttccttatatgtgctttggattttttgaattatgtacattttaaaacatgtacttccagtacatgttttaaaaggaatgaaaattttcattatcaattttggggaagaaaagcaaagaagcagcagagacacaggggcaagaacataaggtagtttgcgaaaggtgggattgtgacgtgctggacctccagcatccgtagtgatggtcacccacacgaataaggcgggcctggtctgggctccaagccagaagtaaaggctgtcactgagccaaatcctttagaggccattcaaaacttccctttatgtagcggcacagtacctgagatacaacctgtcctctatgaatgccattttcacctaatgactgctgtgaagaagagtctagtgatcttctagaagagtctacagcttacagtggcctgcaatgctggctatgcaacaggctgtcctgtgatgtcttaacaatatagcactgtgcggtccctccctggaattaataatcaaagtttccagagctgaggtccaaaaaccactggattgcagtttttaacaggcaggtaggtagcaggcaaggagaaggggttggcttagtaccaggaaaattaaatgaagaaagtgaggcatctactctaaaattggatccttctttcctgacctgccttcagctcgggactatgaacacagtctctgaagagccctatgtgcttcttgccagaacatttttctgaaaaaataataatagctgccattcattgagcacatgttttattccagcactgagcaaggagttttagattgctgactttcattctcacagtgcctcagcgaggaaggcatatctgttttacagataagcatcgcaagctgagaaaagtaagataactgcccgaagtcaggagagcagtggatctctgtattaattactctgctggactgcctttaagtttcagagacttgcgagctcagaggaaatcccggactctaggaatcgggtagggggattggatttggagggcccaggaagctggctgcatgccgcgtgctcgggggtgctctctgccagagcctgaagccttgagctccacttctgcacggcagcatctcagactccagggccgtgctcacctttgcacaacacctttactttcacattagtgctttgcccttacaggggtcggctaggctagcagagagattagggatgtttactggggagagaagcacatgatcacagttaagaggcttaagttacattcccctccagttcctacccactcacattgagatgtgagagggtcagggaagtgctgggtagagaaaggtgggtccctggctaggggtccaccctcaggcctgtgcccacagacctaggtgaggacaggcactcctgtcttcgtgcccaaatactgcattttccaagaccaccctggcccactacggccccgacctgtgcctataaaaaccctgagaccctagcaggcacagacacaacccactggactttgagaggaacatgcccgtgttagagtacacaggcagctggacgtccagaggagcagagtggggaagaacacgctggcaggccatcagccggcggagatggggggccgaggggaatctggccggggccgttggaggggagtccggccacccagcggcccgactaaaagggaaaatcaccttctaaatccatccccttccccctccccacccacctgctgagtgctacttcctccactcaatcccactccatccccttcccactccccacccacctgctgagagctactacctccattcaatcccaccccatccccttctcactccccacccacctgatgagagctacttcctccattcaatcccaccccatccccttcccactccccacccacctgatgagagctacttcctccattcaatcccactccatccccttcccactccccacccacctgctgagagctacttcctccattcaatcccactccatccccttctcactccccacccacctgatgagagctacttcctccattcaatcccactccatccccttcccactccccacccacctgatgagagctacttcctccattcaatcccactccatccccttcccactccccacccacctgctgagagctacttcctccattcaatcccactccacccccttctcactccccacccacctgctgagagctacttcctccattcaatcccactccatccccttctcactccccacccacctgctgagagctacttcctccattcaatcccactccatccccttccccctccccacccacctgctgagagctacctccaacattcaatcagaccttgcactcattctccaagcccacgtgtgatctgatttttctggtacaccaaggcaagaacccagggtacagaaagccgcctgtccttgcaataaggcagaagatctaatcgagctgatgaacacgacacctacagatgacgaaagctgagagcaccctgtaacacacgcccactggggcctcaggagctgtaagcattcacccctagacactgccatggggttggagccccacgacctgcccgtctgcatgctccccatacaggtctgagcagcagggaactgaagtcagccactccccgtgttgcacgccatgtgagggggacaagggaacttgtcccgtttcaacatgaggaaaactctagaattagtccatttgaaaaattgaggccgtggtgcctggcgcagtggctcacacctgtaatcccagcactttgggaggctgaggcaggtggaacatgaggtcaggagatggagaccatcctgaccaacatggtgaaaccccgtctctactaaaatacaaaaaattagccaggtgtggtggcgggtgcctgtggtcccagctactcgggaggctgaggcaggagaatcacttgaacccgggaggcggagcttgcagtgagccgagattgtgccactgcactccagcctgggcaacagagtgactccatctaaaaaaaaaagaaaaagaaaaagaaaaattgaggctgtatctcctcaccatctctgacagccctgctctccttggtcccctctcaggaagcccatgcatcaggacccccaccctccagaggtgttctgcccatccctcctcacacagctccccactttcccaactcgccactatgaccccagacagtccattgtttggtgcacaatttatcttaaacttttgaaatcttcactgaatatttttttttctatcctcttgctttaactaaaacttggatatccactgagcacagtgattgcctataattctttttttttttttttgagttggagttttgctcttgttgcccaggctggaatggaatggcgtgatctcggctcacagcaacctccacctcctgggttctcctgcctcagcctcctgagtagcagctgggaatacaggtgtccacaaccatgccctgataatttttgtatttttggtagagacggggtttcgtcatgttagccaggctggtcttgaactcctgacctcaggtgattcacctgccttggcctcccaaagttctgggattagaagtgtgagccaccgtgctcagccagttgcctataattctttagattgaagcagcttattatttcacaaactaaaaacttcagagtggctactttcataaaattgttctgctgcctgagcgtgaggcccgttccttttgaggctcacagcctccaggaagcctgcctgtaacttccctcatgctcatccaggactccttgccattctacactactcactggagatttaaaagccagggtcacttttttctccaccctgaaccctgttgcatcatccgaaatgacttcagtgttcatggggttgccacattatgcacccgaatttctaagttccttggcctccttatcttgagagacaatggatttcatttcatttcagccacggcttcccactggactttgccataagaaactgtactatgaaatctgaagtttaagttactgtgttcacaatttatcactccgaaaactctcctattatatctcaaaactctgtcatgcccaaatccctgtctgttataaattaaatgtctaccttttctgccttttcaaatgggaggatcagaggtactggtaaagaatttcacagctttagagatgagtgccgctctgtaactgcatggtatctaagctcgataatcaggagtccctgtctccttagccaccttgatctcattctcatcaggagatacttcagacattttctattctcttctgaccaccaagctcatttcatcccctgcagttaaccttgcagacacagaaaaggattgcccacgctgttctcactcccacaaaatcagccctgcagaagaatccctatccacgcccaccctttcccttttctccccttacagtgacacggcatataaagctaatgctttctacttcattatatttttttaaagcctgtgctctgaattgtatttccttccactaactcagtaagtgtagtcttaatgatgacatctccctgctatgttttcaacctttgcttactcatcagcatgaaagcgtatttatttccttcccaacttgaaaaaacaaaactccggttccttggcttcatacacctttttaaagtgttgtctatttagttgtaactgttgtctccatcatcccattaaactgttttcccaaagaatgaaaacctacttgttgctgggtccaaccctttaaaagctttacttctatttttactctatcttaacagctaaattgttttgaattcctagacaccactgctgtctctacaccacaccaagctctcaggctatacttctccatcttctttctaggcatctctttctctaatatatatatatatatattttctctaatatataaatatatatatatatatatatattttttttttttttttttttgagatagagtcttgctctgtcgcccaggctggagtgcagtggcatgatcttggctcactgcaaactcctcctcccgggttcgagcgattctcctgcctcagcctcccgagtagttgggattacaggcacgcgccaccatgcccagataatttttctatttttggtagagacgggttttcaccatgttggccaggatggttgcgatctcttgaccttgtgatccgcccgccttggcctcccaaaatgcttggattacaggcatgagccaccgcgcctggcctttctctgttctttaaaagctgttcttcaggttttggtttcagcacatcaatctcctttctttactgcattaaacaaagtttatggggggccgttgttgggactgcgctcctacactgggccccacagacccgtccaagccacataatcaagctgaacttcaaaaccgtcggctttccaaaaacaggagacttgcagccaccaatcagaaggggcccagttgacctgagccggcctggtaaacaagtaccctttgctttaaccttatgagaaaagtaacttttgaaattagcagtctgctttcatcccagtttctgccttcctcagtccttctctgcctataaagctaaacccacacgttcagctcatcacagcacccacgctattttgtaaaatgagatggtgtctggtcctataatagctaataatagccaattaaatttcaactaaatttgttgttaatttttttaacaaccaatttatttttatggcttcaatttcatcgctcccaaatcattttctgtaactaagtcctttctcctgaacttcaatcctacatatccagcaagtcctgtagacttcctcccaggaacctccaactaaatgttgcaaaatattaacttacagtcttttccctctagcctgtctttcttttttttttttcctttgttttttaatccattttttagctttattgaggtataattgacaaattaaaatcgtgtatatttaaggcgtacaacatattttgacataatacacactgaggtaatcactacaatcaagttaattagcatatttaccccactagcctttctttttcctcttctaatacagatgaatgacatcaccaacaatccagtttccaaagccaaaaattcttcttctcttacattatatctaattcattctgaaaatttgaaaattcagtctctgaagctgctcttaaaagaattcccttcctagtcaggcatgatggcaagagcctgcagtccaagttactttggaggctaaggcaggagaatcccttgagcctagagttcaagtccagcctgggcaacatagcaagacagttactgaaacacttcagcctctgtgtaggtcctgctgctcgccacacagaaagtcaatgactgagacgatgagtattgccaaggaagatggctttaatctttgctgcagccaagaagatggaactcagtctcaaatccatctccctgtggtactaaaaccagaggtttttatagcagggaagaaatgtaacagtgcgtaagaaaacaggaaccagggaggggcaaggaagccatcatgatgaatgaggcgttcagcatctcattggatgtgctgatctggtgactttcagttctttgatactctttttttgagaggcctgaaggtcttttcctgagggataaactcagaaaaaaaatatgttaataagtttcaagctttaagaccacgcgggtcaatttctgtgtttatataaaaaaaatgtctatgagacaattgggtcagtttcaaaaccacatctctaaaaaacaaataaatacatgaataagaaaagaatttcctttctgtctaactgcactgtcatttccctgacctaactatggtcatttctcaactggatcattacattaatttccaagttggttttgcttccagtcattctcattccaattcattctctagaattttcaaaaattaagtcttatagatgaatttcttccctataaattttcaatggcttcttaaagaggtcccatatctcatgatccatcagcctgtatcttgagaggccatattgcactatcttactgcttctatctatacacacacacactctctctctcattccacacttcacccatattggataattcatgttctcttttgatgtcaacccttttgctcatgtctcatttgctcagaaaacttccctgtttgtcctatgcctcttctcttgcctccaatacactgccttgtctgaatggggtcatcttttaatcaccctttagcctcctctcagacacctttttacctgaaaccttcctagaatctgtaccaataatattaattcaagtggagtctgctctttctcataatcactactcacaccgtcaccatggccactccacaaaatacactggggtggagcggtgggatggggagtgaatttaatttggaacattaggtgtctgaagtacccttgtttatctatgaataaatttatagatataacggtctgaagcttgaagagatctgggattgagatacagatttgagaatttttggaatatagatgagaactaaaaccattggaggggatgagatatttggagagtgtgtgcagaatgggaagaggcgagaagagaagacagaagaggagaagggaggataggaagcaggacagaacactgagcgtgaggagggttcgttggccccacccaggtacgtggttggttctttggataaccagcattctgatctcttggataattacatctttccccattgtgttcagccttggtgtatcaaaaatcaattgctgtgccctgctgtagctgaggaatgtgattaaaatctcctagatcattttgtcttgagtagagtagcacaaggacaggaaaaggcacaatagttgtagagtatttattttagatcaggaaaactgttgaggctctcgcatgagttcttgctgctcagattcctgaggcttcatggtttcccatcctcttataaataattctacttcttttttttttttttttttgagacggagtcttgctctgtcgcccaggctggagtgcagtggcgggatctcggctcactgcaagctctgcctcccgggttcacgccattctcctgcctcagcctcccaagtagctgggactacaggcacccaccaccacgcccggctaattttttgtattttcagtagagacgggttttccccgtgttagccaggatggtctcgatctcctgaccttgtgatccgcctgcctcggcctcccaaagtgctgggattacaggcgtgagccaccgcgcccggcccataattctgcttcttaagccttcccttacagccagggagttacagatatggttccaacaaagtcctttcctgcttagaatgccggagccagcttttttcttttttcttgccttgcaagaactcagttacactaaggaaaaacgacattcatgcgatgttagatactaggaggaaactccaaatgagatagaacagcttctaagggtgccattcaagatgtttcaagaaccaaagaattgatgtcaaaaggaaaacgagtatttcaagatgaaagtcattattaatagagtggtttaaatattttactagttttattaaataaattaatgaaaaatataaaattaaattaaatttaaagttatatctcacttgtatttttagttactcatcaatttttgttttttaattgtgttcttatagattgttttgtatttttcttttctaaccttttaatgtatgactatttttattcgtattttctatgctagtaatgaaagcatttaaagtgtattttaaaaaataaagctaattcattccatcattttagtatttgttattgctcctttaaatatattcttttattttagttttgatttcatctttgacccaggagatccttaagagtgagttttgaaaatattaatgtataggaacaggaaacgaaacaccacacattctctcttattagtgggagctgaatgaagaggacacaaggtggggacaacacacactgaggcctgtgggggtgtgtgggtggagggagagcatcaggaagaatagctaatggaggctgggcttcctaccttggtgatgggatgatccgagcagcaaagcaccatggcacatgtctacccatgccacaaacctgcacatcctgcacatgcacccctgaacttacacaaaataaaagttgaagaaaaaaaaaaacaaaacaaatttaacatatttggccagttctattttatcttctaggaatagtttctccttttttgtattatggttaaagaatgtggttatttatttcattttggaaattatcaaagtcatgtttttatatgtaatttcagatacactttaaaataaatgttctgcagacacttgttttcagcttacagaattgaacagacacaaacataaacaaagtctttttcattataatatttagtcagttgtatccattatttctggtctctttgatctgttacagaactggatgagtgtgttgaaatttcttaggatggttacatttccattgattcctgcagttttactttagtgtgggagatgaaaaagtaaagattcatgagagttacgttctccactgtgaattatgctccttataaattacaaagtgcccttctcattttcttttcatttgccttgaatccaatgtggtctagtatcagcagccgaactgcggtttgtttccgtgtttaatcgtctgcaatgtattgttgactagcgtttacatgctgccctgctttgtcccttccttctaggcagaatatttttttactgcttcgtcccttccttctaggcagaatatttttttactatagcttttttaaaaaaaatacgaaacttgttcccccttttttaaaaaggtgagtttatctacttaaccttatagttatgtttggatttaatttagctttattagattttctctttttaatgactgctgtttggaaaccgcctggttacttgatagccagggcatcactgaggtcattctttaacccttctcattaccatagtacttaaaattatcaccatcattttaaagaataaacaacatgataatctctgtctctctctttgtgtatatatatgtgtgtgtgtgcatgtatatatatactttctctatatattcatatagatagtctacctattgacacaacatgaatacactatagatgtgtgtgtgcgtgtgtcagtgtatgtttgtatttcatatttataacatcccaacatgacacatgctttttacttaggtacacatgttaacatagttttagagatgagaaattgaggagaagcaaaattaagaaacctgttccaatgtaacctggcaagttggcagatctggcatattaattaatgcattatgtgctattactttcgcggcctctgagcactttttttttttttttttttttttgagacggagtctcactctgttaccaggctggagtgcagtggcgcaatcttggctcactgcaacttccgcctcctgggttcaagtgattctcgtgcctcagcctcccgagtagctgggatacagctggccaacatggtgaaacccatctctactaaaaatacgaaaaattagccaggcatagaggtgcatgcttgtaatcccagctactcgggaggctgaggcaggaggatagcttgaaccaaggaggtggagtttgcagtgacccgagatagtgccattgcactccagcctgggcaacaagagtgaaattccatctcaaaaaaaaaaaaaaggagattttatttttagaacaattttagatttacagaaaaatagagagatgcagagttctcataccctgcacctggtttctcctattatcaacctcttaacctttgttacaattaataaaccaattttgatacattaaagcagttccttgaataacatgtttttcccaatgttagtttgttacaatgttaatttttttttttttttttttttttgagatggagtctggctcttgttggccaggctggagtgcagtgagcagcataatctcggctcactgcaacctctgtctcccgggttccagcaattctcctgcctcagcctcctgattagctgggattataggggcccaccaccactcctggctaattaatttttgtacttttagtagagacagggttttgccatgttggccaggctggtctcgaactcctgacctcaggtaaaccacccaccttggcctcccaaagtgctgggattacaggtgtgagccacagcgcctggcctacaatgttaattttttaaaagtggcttcccagcaaggtcacctgtgtggagtttacaggttatccccatgtctgtgtggattttcttcaggttctcacggttcttccagttcccaaagctgtgctcattgggttcaccagcacgtctccatggtactggggtgagtgagtgtgggtgagtgcgggtgtgggagagtgagtgtggatgggtgagggcgagtgtgggtgaatgagggtgagtgagagtgtggctgagtgaatgtaagtgaatcagggtgagtgtgagtgtgagggagtgaatgtgagtgaatatgagtgagggagggtgagtggatgagtgtgggtgggtgtgagtgagtgaatgtgagtggtgggtgagtgtggatgtgagggtgagtgtggatgtgagggtgagtggatgagtgtgggtgagtgtgagtgagtgaaagtgagtggtgggtgagtgtggatgtgagggtgagagtgaatgtgagggtgagtgtgaatttgggtgagggtgtcatcttgccctgggagagcgtcctggccaggaagggtcctgcctggcaccctgagctgcagggatgggctgtggccacccgcgatcctgaactggataagcaggtaagtcattatctcacttgtttttattaatctttcttaaatgtacatctagctgacatttatttcaatgtttaatatgagaactgttttggtctttacttagaagttcagtcatgtttctgtgaccagaaatacactacaggaacttcaccctggtctgtggcattagcctacgggaaaatttgttttgttacagtaatttagcttcaaatcacagtttccacgaacctatggccaaggtggacttaccttagagaggatttgcatgtgtggttactgagagctgctgcgcatgaggaactgggccagattccatggggatggcaaaaatggatcaagaaataattctgttctccagctatttataatgtaacatagaaaataagacacacataaattaactataaggtcatttttgctcagtgtggtggaagtagtttaaataaatactagaatatggccagacacagtggctcacacctgtaattccagcactttgggaagccaaggtgggcggatcacgaggtcaggagattaggaccatcctggccaacatggtgaaaccccgtctctactaaaaatacaaaaaactagccgggtgtggtggtgggcgcctgtggtcccagctactccggaggctgaggcagagcgagactccatgcccccacaaaaaagtgtgtgtgtgtgtgtgtatatatacacacacatacactttatgtttacatatttatatttatttagtttatatatatataaactagaaaatagagagataattaatgaagagaaatggtagtttggaagaaacagaaaaaaaacataaaagtaggctgggtgcagtggttcacacctgtaattagcattttaggagcgcgaggaacagctgaggccaggagttcgagaccagcctgatgcagacggtgaaaccccatctctactaaaatacaaaaattcaaaaattagccaggcatggtggcgggcacctgtagtcccagctattcaggaggctgaggcagaagagtctcttgaacatgggagacagagattacaatgagctgagatcgcgccacggcactccagcctgggtgacagagcgagactccatctcaaaaataaaaataaaataaaatactagaataattgatagaaggatgtttttgtgaccagaaatatgctatagaactgaattcttctctatatcaattagcctgttggaaaattggtttcattattccaagaacctattgaggaggtctaaggtctcctcctctattgaggaggtctaagtgaggccttactgtcctattaactaaagtctgtgttttattctgacatctttagttttacctgatgtctttttcagttccaggatcccaccttgccctgagttgtcacgccccgcaggctctccttggctggggctgtttctcagattttccttgttttcgaggaccttgacagttttgaggagtactggtcaatcattctgcaggatgccctctgttgaaatttatctgatgttcttctcatcatttgatcggtattacgagttctggagaggaagacaagagcggcaaagcggcgttcctctcgcctcacatcagaggtgcatactacaggattcctcacagtggatgttgacctcgatcccctgccgagaagcgttggttaggtttcttcattgcagacccactccccccaccccacactgaactcctcagagggaggtcactgtgtgcagctcacacgtacggagcagtgactcacgcttcccttctgcaggtgcagtgtccatcgattgctaggaatccttctgttaaggagatttgtctcttctccccattcatttatttacttgtgctgtgcagtcatttatttatgttggtggagactcactccctgccctttccgaagtgctctgtgtttaggtgataaattacgtacccattatctttgtttatcacccacagctccagctcatcttacttcttacttttgttttgctttggcctcagatttgccacttatattacattttcatggttgtgcttgtggcacattccgtgtcgcgtggtgcaatcctggaatattgtggggaatacataattctgtaggtcacgcctgagtacgggaaagagaagtgcacggaagtgtgtatggtggtctcatgctgcacaggtgtggcagcagccttgtgtctctgggtatcagaagtaatacatggagtagcataaattggaaccatgcaaagaaatttatttacgaatcgtgtggccgggcacggtggctcacgcctgtaatcccagcactttgggaggccgaggtgggcagatcacgaggtcaggagatcgagaccatcctggctaacatggtgaaaccccgtctctactaaaaatacaaaaattagccgggcgtggtggcgggcgcctgtagtcccagctactccggaggctgaggcaggagaatggggtgaacctgggaggcggagcttgcagtgagccgagatcgccccactgcactccagcctggcaacagagcgagattccatctgaaaaaaaaaaaaaaaacaacaacaaaaaactagaatcatgtactttcagctttgctatcagtcatctcacccttggaaagccagaataagttactctgggcaatgtcaaggaagatttaatttcagattgatgttgtttcctcagacagtccattcttctttcctttcagtcagtctcacaggcgtttccccaaacaaacatccctgcttgcaactgtatctcctaacacaaccgatcacaagagcacgcagccaagctgagggcagaatacggatgcgtgcatcctattcactaacctgctaaggcactcatgctggataagaccctcacatcttcccccattcctaaatccctaatgcatctgtccccccaatcttagcaagcttaatgcttaaaataaacagttttatgtagaaagttatcccattgacttttctggtcttctcctctacaaagaaacttgatataaacatttgtggatagctttttcaatgagcatatacttttatctttcttggataaatacctaaaattggctgggtcatacggtaggtgtgtatttaactttgtaagaaatcgccaaactcttttccaaagttccgtgtattcgacattcctactaccagcatgtgagagttttagtccctccacatactgggcaacacttggtacagtcagttgttttagctttagacatgctagtgggtgtgcagttgtatctcattgcagttttaccaaatggcttttttggtgatgtgtaatatagtctgatggaactctttcaacttccttattttttaaaattgatacataataatcatacccatatatggggtacatgtgattatttatttatttattatttattttttttttttagacagagtctcgccctatctccaggctggagtgcagtggcgccatctggactcactgcaacctccgcctcccaggttcaagtgattctcctgcctcagcctcctgagtagctgggattacaggcgtcccccaacacgcccagctaatttttgcatttttagtagagacggggtttcaccgtattggccaggatagtctggatcttctgacatagtgatctgcccgcctcggcctcccaaagtgctgggattacaggtgggagccaccgtgcctggccataggtgatattttgatctctgcatacaatgcagtgaacatgtcaggatacctatcatcgcaaacctcatttctttgtgttggaacattttatttatttatttatttatttatttatttatttatttatttatttttttttttgagacggagtctcgctctgtcgcccaggctggagtgcagtggcgcaatctcagctcactgcaggctccgccttctgggttcacgccattctcctgcctcagcctcccgagtagctgggactacaggcgcccaccaccacgcccggctaattttttgtattttagtaaagacggggtttcaccatgttagccaggatggtcttgatcttctgacctcgtgatccgcccgcctcggcctcccaaagtgctgggattacaggcgtgagccactgtgcccggccgttgagaacattttaaatctagttattctgaaatatacaataaattattgttaactactgttactctactgtgctattgaacactagaacttatgccttctgtctaattatgtttgtacatgttaagcaacctctcttcatccttctccgccagttcccagcccctggtgacctgcattctgctctctctttcaatgagatcaactttttaagctcccacatatgagtgagaacgtatttgtgtttctgtgcctggcttatttcccttcacataaagtcctccaggctcatccatgttgccgtgaatgacaggacatcattcttcttatggctgaatagtattccattatatatatttaccacatttaaaaaatgaatttagtttataaattgtcataaatttaacaaattttaaatctgttcatttatttaacaaacatgtattaagtcttttatatgccaagctctgtgttaatgcggcattggttatacaaagatgaattagatatttatttttgttttggtaaagtttgcagtctaggagcagatgtgttggacatgttcaaagtcaaattacagtatattgaggtgtgaactaggtggaaatttgggttttgaaagtgaaaataaggaaaacataaaaacatgaaaggatctcaatattaggttatatagagagaggggaggccaaggaaagaaagtgggaagtagaaactggagattggaggaaactaggagagagaaaattctgaagatttcaaaagaagaaagattctcaaagcaaggcatggttaacaaatacaaatctgaggagatgcctactggtgtgagatctgaaatgaacaccttgggtttggaaaagggagtccacaaatgatcttaatatgagtatttttttgtgttgtaataaaggtgaaagtcttttatctagcagtaagctagaaaacttttactgatttttaaacagaaattctctagaaggttttgatttttttctttctgtaggtcacatattttactgttactttcattctcaacatttctaatacaaatactatatatatatatatttctttttttttttgtgagatggagttttgctcttgtcgctcaggatggagtgcaatggcgcgatctttgttcactacaacttccgcctcagcctcccaggttcaagcgattctcctgcctcagccccctaagtagctgagattacaggcacctgccaccacgcccaggtaatttttgtatttttagtagagacggggttttgccatgttggtcaggctggtctcgaactcctgacctcaggtgatctacctgcctcggcctcctgaagtgctgggattacaggcataagccacagcgcccggccaaatacaatattaatttggattatatttagctgtgtgttgctgacagtcatacacactattgagattttatttattttatatcattttctttttgttaaagtcaattttagaattcgtatagcatttttgaatttttgttgttgttgttatcaaacaacaatgtttcgttcatttgtttttcactatttgttcccagtgtttttggttatatctaagtgtatcgtctgaattcttaaaacactaacatttgtggcagttgttgccgtactgatttcttcccagttttaaaaagaatgactgggattttggaggaagtttaacattaacttttagtttaaaataattttgtttcatcagaagagaaactattttttcctttttcaaaatatttaaattgggaacgaatattgttcttttaaaaaatattcttctggccggttgcggtggctcacgcctgtaatcccagcactttgggaggcctaggcgggtggatcacgaggttaggagatcgagaccatcctggctaacacggtgaaaccccgtctctactaaaaattaaaaaagtagccgggcgtggtggcgggtgcctgtgatcccagctactcaggaggctgaggcagtagaattgcttgaaccctggaggcagaggttgtagtgagccgagatcgcaccactacaccccaccctgggaaacagagcgagactgcatctccaaaatatatatatttttctgatattagttgaaagtatatgtgtgtgtgtgtgtgtattgtgtgtgtgtgtgtatatatatatttgttttcttctttcagtctttttaacctatggtaatggtgtctattcagattgctctattctcactcagctgtagatgcttaagaccgtcaagctctctatcttgccctgttcgagtggaggcagcgtaggagtggatttggaccattcccggtgtctgaaacgattgttattcatccagcgtgcccgcagtgaacttccggcgtgtatgttctttccctggccctctgcttcttactctctgtagtagagtgtagcagatcctgtttgtgacttgtccatattcttttggcccactgtggaggtctgatgcagcttggtgacaactccttcttcgtccacctccatctctcagaatgatggtgtgaggcttcctgaaatacacctcacagcttatctgaaaagctccccaataaactatttgaacccaattcttgcctcagagtttccagttgaaaaaacacagaccaagacagtggctatggttttgctttcctgagtgcacgttgatttctcttaggagtaccagatcctgcctggaaccacgctcacctggctgtagtctgaagtcttccattcttttatattgaccacattttccatttctactttcctctgactgatcccacttcccagaaaacccacagagcagatcctgtttgctgaaaccttgctccagaatgaatagactattttttcctccgcagcttagttgccagatcgtgctccttcggctataggatggagttgaaatttgctacaggcctttgcacacgaattcgtctgttgcaaaatttctgaggaggctgtgatgacttgtgtgttagtcccacttggttggccccatccactctggtttttttcctcccctttcacatggactcatttattacattctagaatgtctccaatatgagttttcctgcagaatggtgcactttataataataggtggtttcttgttcttgttgctgaatgattatgttcctgcaataaattcagtttgttcacagtattttaaaaaattaaatctattactaaaaagtcttcattagtattttctttgatttttttttacagatatattcaacatacataggtgtataatttttagacattattttattaaggtttggaaatatatgtttgccaacgggaatcaattaggtaacatttcaacttctacaatgttacacaggggtttaatttttagaattaattttttggacacgaacattgtagcataaaatctaatttgctgcacatatttcaagtgctttgaaaatgttttatatttcactttatttatgagtctaccttatgaaaactgtgggtttttgttacatcaatttttatagtttactttttggatacagttagaataatgaaacaactcccttgactgtaccacagatacacagaatacaagtatctcccatacctaacggtagtacaaaatggggttgtggaaaagttgcggcagaatgaaatttctcagtccttagatcttcgtcattgctgagtcatgttgacatttttgattaaaggtcagttggttctttcatcttcgtccttgaatcctcttctgccttctgctttaaccgttggctcactttgagtaaggcctttgcccaattctggaaactgttggcttatattattttcccactctactaaaacttcaaatctttctattcatacacataagcaagaatgaccccagcctgtttttgagaaggttcttatagcggtgtaacgagaggtgcatacatgctgatgggctgcaatgaggttctaaaagggatgcccacatcacttactggaaacaaaaaggcaggagtgttgcccttgtgcagaaaataaatacttcaatgctgattaggagtggctttacttcaccagaaagtcacagggcaaggctagtggttataattatctctatgattttatataaatgtaaaatcataaggctgaattataataaattgtcatttttataggttaaaaagatgattcaatgtcagcaatttaataggattcaacttaatactatttcctttgtaagtgagaaaacggaagcacagggaggttagacgacttctgagatcacacagagctggcaaatgaagtaatacacgttagcttgttacactgtgacacttcccaacatgaaatccctgggagaatttttggcatactgattttgctttgataaaaccattcttgcttttgtaacagctaactgttttaataaattaggaaatggaaaaaatgggtgccaattccaaccattgaaaaggtttatataatttaataatccccattaaactaggtgatacagagtttatgctttatacattttaaagttacgtttcactttctacctgaccctagatttagatatcaatcgctatacattttgcaagaaatatagaaaatatattgattcgtcttacttgtttttacttcctgtcttttccctccctccctccctccttccttccttttccttccttccctcttttcttccctccttccctctctccttccctcctccctccttccttccttccccccttccttccccccttccttccctctcttcttccctccttccctccttccctgtctccttccctgtctccttccctccctccttccctgtctccttccctccttccctctctccttccctcctccctccctccttccttccccccttccttccctctcttcttccctccttccctccttccctgtctccttccctccttccctccctccttccctctctccttccctcctccctccctccttccttccccccttccttccctctcttcttccctccttccctccttccctgtctccttccctccctccttccctctctccttccctccttccctccctccttccctctctccttccctccttccctctctccctccctccctctctccctccctccctccttccctccctctctccctccctccttccctctctccctccctctctccttccttctttctctcttttcttccctccttccctctctccctccttccttccttacccccttccttccctcttttcttctctccttccctccttccctctctccttccctccctccttccctctctccctccctctctccttccttccctcttttcttccctccttctctctctccctccctccttccttccttccttccctccttccctctctccttccctctctccttccgtctctccctccttccctctcttcttccctctctccctccctcctttctttgctctacttggggtgtgtgtttaaaacgttctttaattaatcgcttacttattttaactttcttctagaaaaagtgtttaaatctaaaactataatgttaagcactgctttgattagattccgtgggaaatgatacaaagtattttgattttcacagttttctaaacaatatgtcatcaagtattcaattttctcttgaccaagttattatttagaaaaatacttttaaattttccagtatatggtatttggtgtttaaactcatacaattaattaaaaaattctacagattccatttggaatttaaaaagtggtataattacattaaaaattatgcagaaaaatgaaaaagccatccccaccgggctaaagtaaaactttaggtccatttggtaaattaatcttttctcacatgcatacttacatttatagaattgtacaaataagtttttttgcaaaatttacagttcgttttaatgtatttctaccaattactccaaaaagaaagctattcatttaccatttatgccgtgagcattttccatattgcttgcataaatgtttgtaattattaattctattgggaagcatagtattctaatgaccgaatgtactaaaacaattttttaaatcattggacatttaatttatttctatttgagggctatgataaacaatgctcagttgaatttataactccttccctgttttagattattttctaaagacatatttacataaatggggttctggcccagaaagtatgaatatttttatggctcttaatgtaatgccgaattgcttccctaaagcactggagcatttaaaaacacaatcagaaacgtgtgagagtacccatttctttattcccttgccagcatgagaaattatcattttaagccatttttttctaattgaagagatcttaaagggtaatgtgttttaatttgcatgcgttttaattttttgtaagtgtttatatgtttcattcctacttctgaatcttttgttcatgtcatttgaccctttatgtatttccctgttataacgtatatcattatggctgactttaataattattattacatcagtgcaatctgtttttgcatatactgcattttattctcttcagatactactcatgatacaaatattcattggtatagtgagaacaatacttaatgtttgctgttcaatacagaccttcgaaggcatattcaatatcacctacattctatttgattaaatacattcagacactgcattacactgacaatacatgtaaaaattataacggtataatgtctgaggtagccagaaaaacatgaaaatcacccgtgtagccaggaaaacaataccatccaccgtcacctctcagtgttaacatttacgcattaacaatggttttcgtgtgattagcagctgctttgcaggatgattacatgcaaaccacgcctatctgaatcttggggaacactaaatctatttttaaactaacagggtagaaaagaaagatggcccagtgttggctccaagcaacctccatctggacctcttcctgtgcatagaagcgctcccagggtgtggaggtggggccgcctggaaccaggggctggagcagcaaagacagttgctgtgttctggaccgttgttttgaccacggcaattagcagacctgagacggaaaacgttcccctgcgaccctagcaggggcgcggcgtgggggtggctcgcttcttcagagctgctcaaagccccgcgggcgcagacagagggcggtgcggctcctccccacggcggtgtctgcggtgagtgttgacggctcctgaagccccgggggcgcgtgttacaaggcgcccccttagtttgccgtctataggcggctcgtgttaagcagctcaatagacccccttccttatcgcaaggacagagggatttctgcattccgggttcttgctttggggtacctgaagaatcggggcacacgtgggcttggagaatgagtgtcaagtgttattgagtggaagtagctctcagcctatgatggaggcagaagggagatggttttcccctcgcgtggggccgctcggtggccccggccaaactccgcctcgtcctgccagtggatggccaccagcgtgctcctcccgaggtcccctccacgaccagccgcttgcaccttcttctgtccatgtgctcctctggacgtctgtgtgattgcctgctagagtctcggttttgtgttgttgttttcttgagacggagtctcgctctgtcgcccaggctggagtgcagtggcgccatctcggctcactgcaagctccgccccccgggttcccgccattctcccgcctcagcctcccgagcagctgggactacaggcgcccgccaccacgcccggctaattttttgtatttttagtagagacggggtttcaccgtgttagccaggatggtctcgatctcctgacctcgtgatccgcccacctcggcctcccaaagtgctgggatcacaggcgtgagccacctccccaccccgcccacggtctcggtttttataggcccgggatgggggcgtggcaggccagggtggtcttggaaaatgcaacatttgggcaggaaacacctgtcctcacctaggtccgtgggggtggagccctagccagggaccattccctcctctacccagcacttcccttcctggcttcggtattatttaaagggaccacgctcttcctttcccagcacttatgtatcagatccagtctaaacagattcccactgagtccagatggggggattactaccctcaggcctgtgtgcctggtggctgtctctggagtggagtctgttcccgccatgaagctgtcgaggcggtccctccaagctgattgcgttgctgttgtcgctgctctttcatatttctcctgtgtctccttgagccccagatcgggacctgctcctttcgcagagcgtatgatctgaggggttgtaatctgggttggaggctttatcttcttttagaacttggtcccctgctgccctagtagtcccctttccccatctaccagcacccagcagcaccctcctctgtggcccctgagctgcttacagaaaaccaaaaccaaaatcaggagtgcttttggaagcagagtcagcctccaggtctttgctccacattcggcttaccctgtggatggctgaggggagtgaaaccagggagctcaattaacatctggaccctggcccaacctggaagagatctcttggacttgtgagaattaatttaggttcagaaagtgcttagaacagtgcctggaacaacgtcagctcttaataaatggaagctattatcttctatatataggttagttctgtttctcaagttctccctggataaagttttcacgtgatcaacaatggctgcttgttagaaattgttggaataaaataaaaagcatgcccagttggactgtgtgtttaatgtgtacggtatttttaaaaaataacttttcctattaattcttttgaacctttttgatttttttttcactgagagcagaggaaaaagctacattcttcatcagttctaaatactataatcaagagttagactcattagaatggaaggctatgcaaactttgactttagatcctgtagaatgtctaatgtacaataggtgcttagtgagcagtaatacataaaacttatataacttttgtaccaagtagagttgtaagtgcttgctttacctatattaactcatccatcttttaactcactcctgtaacattagcagcaatgtattttttaaaattttctaaatgaggaggccgggtgcagcggcacacacctgtaattccagcactttgggaggctgaggcaggcggatcatgaggtcaagaccatcgagaccatcctgaccaacatggtggaaccccatctctactaaaaatacaaaaattagcctggcgtggtggtgggcgcctgtagtctcagctactcgagaggatgaggcaggagaatcgcttaaacccgggaggcggagcttgcagtgagccgagattgcgccactgactccagcctgggcgacagagcgagaccctgtctcaaaaaaaaaaaaaaaaaaaaattgtaaatgaggaaaactgagaaacatggccaaggtcattgagctggtaggacacatctggaattcaaaccaagatatatattttgaagaatctatatgaataaaagccccacttttgaaattaaaaaattctgacagaatcaagtaaatgcaaattaaaatagtaaccagacaccattttacttctatcaggctaacaagaaagaaattatgacaacactcaataaccatgagaatgtggatccaggtaatgcgcaaacattctggtagagtgaagtaagtgaaaccactgtgtagagcggtttggcagcatctggtaaagctggaatgtacactcccaaaacctggcagtttcactctcaggtaaacacctgagagaaagattcttgcacaagtgtttaggaaggtgcacagcattgcatgtaaaagcaaaataattgaaacagagtaaatttcctttgtcagaataaataaattaattgtatcattggtatataatgcaataacatatagaagataaaaggaatgaagtagaactacatgtctcatgctttcagagaaatctcatacaagttgcagagcaatggtaaaagcaaattacagaataatacgtacagtaggtgtggcaccattctacaaaaattatagtattaatcactttattgttttcaaaaaacatccggtgaagacatgggtacacttcaaaaatgactgttaggactaatccatgctgacggacggcaataccatagtgatgaaatatcatagtgattaacatatgagtgaaaagaaaaagagtgatacatttcattgtctttctaaatgcacactttgttatcaataattaaaattttctaaaagcttccaaattggaagcttcaggtctttcaggtctatccatagagtatttctttctttatcttttttttttttttttttgagacagggccttgctctgtcacccaggctggctggagtgcagtgactcaatctctgctcactgcaaccactgcctcctgggctcaagcaatcctcccacctcagcctccgaatagctgggactataggtgcacactatcacacctggctaattttttgtatttttttgtagagccagagtttcaccattttgtccaggctggtctcaaattcttgggctcgagtgatccaatccacccgcgtcggcctcccaaagtgctgagattatagacatgagccaccacgcccagccaactgagtaattaaattgaatacttataactgatttgaaaaaatatgaagctacaatccaaagaactcatttatcaaagtgcttccttctaggttgatgtataaaatagttctctgggctaggtgcagtggctcatgcctgtaatcccagcactttgggaggccgaggcagtggatcatgaggtcaggagatcgagaccatcctggccaacatggtgaaacactgtctctactaaaaatacaaaaattaactgggcatggtggcacatgcctataattccagctactcgggaggctgaggcaggagaatcacttgaaccaaggagtcagagattgcattgcaccactgcactccagcctggcgacagagcgagagtctgtctcactaataataataaaataaaatatttctctggcctggtgtggtggcttacgcctgtaatcccagcactttgggaggttgaggcgggtggatcatttgaggtcaagagttcaagaccagcctggacaacatggtcaaaccccgtctctactaaaaatacaaaaattagctgggcagtggtggctcatgcctgtaatcccagctatttgggaggccggggagggggtggataataccttgaacctgggaggcagaggttgctgtgagtccagatcttgccactgcactccagtctgggcgacagagtgagactctgtctcaaaaaaaaaaaaaaaaaaaaaagttctccaagttctcaaatatttctaaactctgattgatgatgggtagcaaagacagaatgtgtatacttctagcatgctgactgatttgtgtgtgtgtatttcacattaagcttcatcctggaagttttgtagttcaatcactctgattgtatggcaatgtgactgtgtaactacagctagtacagcttcaattttgattggtggaatacagaagctggtttggatgaaattacaatagtcactcagcaaatgtgtgggcttggttccaggaccctggcagataccaaaatctgcagatactctagtccctggtgtaaatggtgtaggatttgtgtggaacccatgcacaccctcctgtatacagtcatttctagatgacttacagtacctaatacaatgtaaatactatgtagtgcttatactgtatccatttttatttgtattgttttttgctattgtattgctattttttattttacttttttcaaatatctgtggtcagcagttggtcggctacaccagctgtccttcaagggcagcaatatgcattacatctatcaacactaagcctaggaatcgctaaccacagctgctgattagagagcattttactttatcagagaaccaacaaactgctcttgaaaggaaggaattacttacaggtgcatctgggaaagacgggaaagaggtgggtcacaggccttcagatgtaagcacctgttattgggaggacggctcattgcacatgggtctcccacagttcagatgggacgttggcagaagctggaagtacagagtgaaagtccaccaaagcattctggcttctcttattgcaactatgaataatgattatttggctgggcacggtggctcacgcctgtaatatgagcactttgggaggccaaggcagttggatcaccaggtcagaagatcaagaccatcctggccaacatggtgaaaccccgtctctactaaaaaatacaaaaattagccaggtgtggcggcatgtgcctgtagtcccagctacttgggaggctgaggcaggagaattgctggaacccaggaggtggaggctgcagtgagccaagatcgcaccactgcactccagcctgggtgacagagcgagactccatctcaaaaaaaaaaaaaaaaagataataataataatgattcttcattaaataaataacaatttctaggacaaatgtaaagccagctgggtcactgtacaatgtgagaaaccaggactctcttaggcaaagaacttctgtagtccccctattaatgaccatctatgggtctagcattttctacacgtggatgtttctaccagtgtactcgcctgttagctgactaattgcatttcctggtcattcctctttctgaattgatttctgacattatggcatatctttaatttccaccttctaagaactcttttctttttttctgagacagagtctctctctgtcacccaggctggaatgcaatggagcgatcttggctcactgtgacctctgcctcccgggttcaagagattctcctgcctcagcctcccgagtagctgggattacaggcacccgccaccatgcccagctgatttttgtatttttaatagagacagggtttcaccatgttggccagactggtctcaaactactggcctcaggtgatccacccacctcggcctcccaaagtgctgggattacaggtgtgagccaccgcgcctggctagaatgcttggttttcattatttccttgaatagacctgtaggagctttgccatcatcaagactgccctgttaatcaaacctcatagtaataaacagacagcctggtttcccagccaacaaagatgcatgcatttgacggcttttgaatattaatgttgttgaacacctcctggggctaatcgacacaggcacagaagacttctccaggctcttcagtacaattccgaaggtctacatgtccttcattagcatcctgcaagactttcagaatgttgtatgaagatgaatctttatttacaaaataagctttgaagtgatttgaagaatatgtgaagagcttcttctgagccaagtattcaaggtatttgcttcttggatccaaggatgtcattcatgtggggtgcttaagtctcaagtttccttacatctcaggaaaagtgagtggaatactttcctaaattcattccttcatggatgttgtgccggagagtcacaactgcctctgcacattgtgtatgactgatttcctgatactgattttcttttaagaaaaatcctagcatttggaggtaacagttctatgggaagctttcataaattcttccagtcgggcacggtagctcacatctgtaatcccagcactttcggaggccaaagtgggagcatcacttgaagctaggagtttgagagtagcctgggcaacaaaacaagaccctgtctctacagagaagaaacaaacaggccgggcgtggtggttcacgcctgtgattccagcactttgggaggccaagacgggcggatcacctgagatcaggagtttgagaccagcctgaccaacatggagaaactccgtctctactaaaaatacaaaattagctggacctggtggtggatgtctgtaatcccagctgcttgggaggctgaggcaggagaatcgcttgaacccaggaggcagaggttacggtgagccaagatctcatcattgcactccagcctgggcaacaagagcaaaactccgtctcaaaaaagaaaaagaaaaaagaaagaaagaaaccaaattcttccaccttccattccaaatgcctaatactgcgtaggtctgctgctatttacatacgcaggagataaaagacaacagcaatgaacttgtattgatgagctctaattaatcctaaaatgctggtttatcttctttgatactgtaactggcaggataaagtccttctttctccacaaggcaaggattgcggagaaagctggtgcttattcaagaactcaagagggtcccgacaagcaaaaaactgttgtcgacggtcacttgagagttctctttgttttgcttattcttttgggttttgtttttcttctgaaactgtattactagttcggtgccaagagcttttcacaactaagtttttgttccatgtttctcccttcccctgaagtagctttcatcattcatttattctttctttctttcatgtatgttctcatcaatgtttctcatgatgcaccgactccttcccaggcacaggaataaaacagttacagtctctgatcgcagagtcatggttttgtggagagcgagggcaaagaggcaagacctgggcttgacacaatgcagccattaggtttggtaaatatttggttaatatcatccgtgtccaaaactaatgtaaaacctgatagctttgctgcttctagaagaggattacgaagactgatagtagtacctatttaatcttttatttttattttttttattttttttttttgagacggagtctcgctctgtcgcccaggctggagtgcaggggcgcgatctcggctcactgcaagctccgcctccctggttcaggccattctcccgcctcagcctcccgagtagctgggactacaggcgcccgccaccacgcccggctaattttttgtatttttagtagagacggggtttcaccgtgttagccaggatggtctcgatctcctgacctcgagaccaacccgcctcagcctcccaaagtgctgggattacaggctatttaatctttatgtttgcttctcaatatcatgagaatcctgtcagactcttgttagagaatgaaattaattaaaaacatggagttttaagaatccttagggaatcttcaggcaaaaaaataaaatttgtcttttacagtagtggtttcacccttgctctctaagtggtacctataattcgcattagaacttgtagccaaccatcgtctaaactgagtatctcttgttaatggaagtagcatatctgcgtctcaagtggtaattgaatgaagaaaagcacacacttgattctatgaaattctatgaaaaagttttcaaaaaataaagcatatcgtttaaattaagggaactctatgaggattgaatttttgagtagattaaatgttgcctggggaaattaatgaagaatatatcacaggaagaaatcctgctttgggaagtcggccccaatttacatcgtctgtttccggttaccccctcatggaactgacctggggcaggtgataactgaccctgcctccaggtgttcattcgcctgttcgcaaatccctagaggaatatccagggcacccatggatccagtggcctctcccacataacgatgagtgtgataatatgttacctttgagttatttctggtattttcacttatacatgaacctcttcattgactataaattctttaaggacagggacagcaacgttggtctattttatacctcacttaataaatttcaaaaagccgactgaaaacaaggctagggccaggcacgatggctcatgcctgtaatcccaacactttgggaggccaaggctggtggatcatgaggtcaggagttcgagcccagcctggccaacatagtgaaattccatctctacaaaaaacacaaaaattacctgggcttggtggcgcacaccggtagtcccagctactccagaggttgaggcaggagaatcgcttgaacccgggaggtggaggttgtggtgagccaaggtcacgccactgcactccagcctgggcgacagagcaagactctgtcccctccgtggcaaaaaaaaaaaaaaaaaaaaaaaaaaaaaaaggaaaacacggctagatgatcaatattcagaaaaatgattttacatttaacgtatgctttttttttcttattttcaacctttttctttcttccaaatctcaggaattcgttaaactttattatttatgagcttaagtcaaacttttaccagctcagctataaaaaatactgaataataacttaattaaaagcttgaaaacattttagaaaatcatgacagatggcaactattccacagttaaggggcattttaaaatcactgacgagatatagcactggaaatagtttgcaacttcgatcaattctctttttatttgcttaaaagtgggtgtcagactcattataatgcttttagaaggttggtaataattgatatttgattgtaaaaaaaaccttgtaagcaatctcattttattcagaaaacaataattgtctggaaattcaatttaatgctatgattatagtcagaatgctttatttgaaattgcagactcaatagaaattaagatttcactttcatacactcattatttttttctttaaaaacaaaagaaaagctttccccaaatatatgaagctattacagaagagaagggggtaatcaatttctaatatataacgccatggcaatgaaatgaactataatttaaataaaagcatcttctgttaggtcagcaaaaatgcaaagaaagcattttactagcatcccatttctctcacagtcagaaagatgagactaatgaacagactataaaggttaataacaatctcattttgttctatttattctctcaaaacatattgccatatttttacaaagtcttcttaccccttgaaaaaacaatttcaaagtaactttaggaagtcaatcaatttctccagacaagaaaattgtatgtttggttaaaaaaaagcacttcataccttggattaatttggttcgatttgtaactctgaagagcacatgccacttacctttcataatctctgaacctcagttcacaatctgaagaagtttagagtgtcagaccaatagcacatgtgactacagtggggtgattactgaagtgagcgagatcacccaggagctcgtgtgcaatgcattttagaggttcgttcatttttggcagagataagaggtcacagtctttttaatacacattttttgtggcttctctaacatattttccacagtgactattccaagcctcctctcctcctcagttttcaattgcatgtttcttccgtgtttagcttttttatttggaagaatataaattatttatttaggaggttactaaatttcccccacattattcttggcttttttttttgagatggagtcctgctctgtcgcccaggctggagtgcagtggcatgatcttggctcactgcaacctccacctcccgggttcaggcgattctcctgcctcagcctcccaagtagccagaattacaggtgtgcaccaccacacctggctaatttttgtatttttagtagagacggggtttcaccatgttggtcaggctggtcctgaactcccgacctcaggtgatctgcccaccttggcctcccaaagtgctgagattataggcgtgagccaccgcgcccagcatgttggcgtattttttgtcagctatttttctggtctcctttctttaaaaaaaatattagagtggggtagagggaagagcagaaatttgagattgtgctaaacttggctaagtaagtcggtaattcaaccttgtaagcttcagttttctcatttttaaaatgggcataatggtctgggtgcagtggctcacgcctgtaattccagcactttgagaggccaaggcaggaggatggcttgagcccaggagtttgagatcaccctgggcaacatggcgagacccccttctctttggaaagtaaggaattagccaggctccgtagtgcatgcctgtatttccagctacatgggaggctgaggctggaggatctcttgagccgaggagttcaaggattcagtgagctgtaatcacaccactgcactctagcctgggtgacagagtgaaaccctgtctctaaaacaataaaaataaaaatgaaaaagggcgtaatggtacctacttcactagattgctgggagatgccttatagaaatgcttagcaaaatgtctctattcagctggtgcaaaataaaaatcaacattcgtactttttttaatgaaaaagtacaaatctctgcattccttattactcctttcttttgcatcttaaatctttctcctgcccctggcttcttcctgcgggccttcagacatacagcagcctttctccattctcccaacaacctgcccctcatttgattctctgatctgatcaaaagccgccatcctatcttgctgccttccttctctggcatgtcaacagccactgcctccatttcttcctccttgttctctattcattcactgcaatgtatcctctttccacggaactcctcagaaactgcactttcaaagatttctaacaatctattaaatgtcacattaaatgaccttttctctgtcctctgactatttaatatctgcagaagggttatactcataccttctgggagcaatcttctttcttgatgaatgtggctctcgttggaatttgtggttattccagacgatgcaaaatatatatatatatatttatatatatttatatctatattatatatagatatatcatgacaatagcaatttctgtcaaaaaatgttttcggggagaaagtgagcatgcattttagtacagactatgtactggcttggtaatgtcagttattagatgatttaaatcctcaaattaaactctaattatcaaagtagcaagtacattttctctaggaaattacacaatagagcagtggatagaggtttttttattttgttttgttttgtttttaaacttcacctcttcttctagtcttgccatatagcctcgattcatcaaataaaatactcaggtcaagaaatgtgaaactctgagcttggcttggccataaaacttttcttctcccagatcagggctgctgcaggctggaagtgtgctctgtgaaaggggagtctgcttgtcccctccacatctttgccttgtgcatttcttcctctcttccttagcgaaccggagcttcagctggtgcagcacaggtggaaaggtgggcaaagtgggagaggccagacctgaccagcaccgagtcagcagcacagaaacgctccccagtgccatcaccacttgtcagccattccctttccctctacatcttctgggctagctccaggccccaggccaccagcaactcaactaaaaagcttgcaactaaaagcaagctctccattggcccccttgcagccggccctctctctccaatctagaggacaggaggagggggcactgccctccccagggaatgacttggggttggtaactcagggatgctctctaaagaaataacggcacggatagtctcctccttcctgctcagatctctgaatgtccttggcccgattgaagagtccaatagctgtggagatggtgctcaaaaactccctttgaatatctgcacacattgacataggatctcacttgggagcaccaacataattgccttttggtacctagcaaatcattactttagaaacctgtagcacatactcacatgcatatactcacatacacacactcacatacatatactcacatgcacatactcacatacatacactcacatacacacactcacatacacacactcacatacacacactcacatacacgtactcacatacatacactcacatacacacacatacatacactcacatgcacacactcatacatacactcacatacacacactcacatacatacactcacatacacacatacatacactcacatgcacacactcatacactcacacacactcacatatatacactcacatacatgtactcacatacatacactcacatacatatactcacatgcacacactcatacatacactcacctacacacactcacatacatatactcacatacacacactcacactcacatacacgtactcacatacatatattgtggacatcttttcatcttaggatattcttctctttttatttatttatttttttggagacggagtctcgttctgtcgctcaggctggagtgcagtggcacgatcttggctcactgcaacctctgcctcctgggttcaaatgattctcctgcctcagcctcctaagtagctgggactacgggtgcgcaccaccatgcccggctaatttttgtattttttagtagagatggggtttcactatattggccaggctgctctccaactcctgaccttgtgatccccctgcctcagcctcccaaagtgctgggattacagacgtgagccacccacaccctgcctcttcttaactttttgtaagggaggatactgggtctcagagatgttaaggatcttgcttaagtatatacaactagagaaatttgtaaaagtgggatttaaccctatgtctgcctgatgtcaaagcccatgtctatatcctaactgtgtatctctttcctacatttatgtagtatctcccagcttctcaaaaattgccccaacctcctaggcagtgtagatttaggtaaagcttacaatttttgtttaaatgttactgtgtctccagggcagggccgtgaatgttgacacattcacagaaagtatgtaaacccagctagttacaagtatgtcgcctacacacataggaaagaagcgtgaacagaccgggcttctgcccaggagaggttgtggacctctgagtttcttattcattcatttcttcaattatccagtgaagggaactgagcactctgccatagtaatgaacaagaaagacaaagtctatcatcgtgtttattcttctgctgggagagatgaatacgtacaagagaattcaggttgttacaaagttagatgtctataaatcaaggtaatgggggtaatatgtcactgggatgttgaaggaatcctgagctcctgcgtgaggggagccaaggagctagtcctgtgaaaagtcaagggaagaaccttgcggtcaggagtgtgtgggagccgcattgagactggatgcacgtggccccacttagcaattgttggaaggtgggttcagggctctgggttgcaggcagcccatggtggacccctgggctggagcctcagaggggggtgcctgcattggcttccatcatttaaagctcctgaggccaggtgtggtggctcatgcctgtaatcccagcactttgagaggccaagacaggaggatcacgaggtcagaagttcgagaccagcctggccagcatggtgaaactctgtctctactaaaaacacaagaaattagccggacatcggggcgcatgcctgtagtcccagctactcgggaggctgcagcaggagagtcgcttgaacccaggaggcggaggttgcggtgagctgagatcagaccattgcactccagcctgggtgacaaagcaagactctgtctcaaaaacaacaacaacaaccagaaaaaaaaactcctgaaataatggggtgggggctgtccacagacatcctcttccctgtgcgtcccaccagtgcctggggggctgctccgttcaccccaccccttcaccatcatacctaggtagaatgcccgaccttctcctttgtctcatgtcatacttcacaacagttttcaaggcctgatgatctccatgtttcagatgaaaatctaatgcttgaagcgggtagagggacaggctttcctgactggatttctgattctacttgcttgtaatttcagtcatagtgtctataaagagacttacggattgtgcctggtagagttctaagatggacccccaagactcgtggcccctggaacctccttccagttattcagtcaaatactcatctagttactgctgggaagggagtgtgaagatatcattaagggtctaaataagttgattttaagaccgggagattatctacatgggcctgacctaattacatgagccccctctaaaagaagagaattttctctggctggtcacagagagaaagtcagaaacgtcctccggctggtctgaaagagccagcattcacatacacactgcccgtggagtaggtcatgtggtaggaatggtacctgcctctggggcataggaggcatccctggctgacagccagcaggaaaataggacccccatcccacagctgtggggaaatgaccccatccatgccagggaggttggaccaggacctcacgctcccggggagtgccacacctggccaacacctgatttcagcctggtgagaccgggagtagaaaatccaactccactgtgcccggacttctgacccacagaaactgtgagggaaccggtttacattgtgtaaagccactatttgtggtgatttgttaaacagtattagaaaatgaaaacacaggccgggcgtggcggctcacactgtaatcctagcactttgggaggctgaggcgggcagatcacctgaggtcaggagtttgagaccagcctgcccaacatggtgaaaccccgtctctactaaaaatacaaaaaattagccaggtgtggtggcaggggcctgtaatcccagctacttgggaggctgaggcaggagaatggcttgaacctgggaggtggaggttgcggcgagctgagatcgtgccattgcactccagcctgggcaacaagagcaaaactccgtctcaaaaaaaagaacaagaaaacacatagactgttcacagattttaggagctcagcttatatgaagaaaactattatggctttaaagagagggttcggaagcaagtcttcaactcaggaatcagatggtcaaatcatcatgtgaaatcacagttaaaatcagtaatgtgatggtttatggacggcatgtggagcccattctgtatcttcttataactcctttattactgcaaatatttgaaagcaaataaaaatactgtatcataaacaatacccttgggccaggcttggggactcacacctgtaatccaagcactttgggaggccgaggtgggcagatcacctaaggtcaggagttcaagaccagcctggccaacatgcagaaaccccgtctctactaaaaatacaaaaattagccaggcatggtggcaggcacctgtaatcccagctacttgggaggctgaggcatgagaattgcttgaacttgggaggcagaggttgcagtgagctgagatcgtgccactgcactccagtctgggtggcagagcgagactccatctcaaataaataaatacatacatacatacatacatacataccacccttgttctgaatgcttgtgcccacaaatccctttattatttatcaggaatgcacattttatcagaccacacgtttcaagttcaaggctccacctaaatactgacatgttaacactcctgccatcctccagaaaatgttaacattcagcatataaaagataatacggcagcacaggcatagatttcttgttagcctgcagaattgtaagtatttagcttgataagctgcagaattataaaatggtaaaatattaaataactctgagtaaaggagaagcatcaaaaacctgtaccaattctgcctatcttcattagctatatgcatacaacacaatgtgaatcactctttggcaaagatgcagttcatttgatcggtggaggacaccagcttcagatggaaaaactataaatttcacctaaaaatcaaatacatctggtgcatcatcagagtgttgaaatgtaaaagatgtgtcttatactgatgttcattttggggaagctaaaatggaggagcttgccagtgtatccatagaatgttgaaaatatactgggtgttaccattaggaaatagcacctttctgaaggttctcctgagttgctttcagtagcaagtgagtacaagaaaacactggcaggtgagcaaggtggctcatgcctataatctcagcactttgagaggctgaggcgggcggatcacctgaggtcaggagtttgagaccagcctgatcaacatggaaaaaccccatctctactaaaaatacaaaattagccaggcatgatggtgcatacctgtaatccagctactcaggaggctgaggcaggagaatcgcttgaacccgggaggtggagattgcagtgagccgagatcgcaccactgcactccaacctgggcaataagagtgaacctccatctcaacaacaacaacaacaaaaaaaaaagaaaagaaaagaaaagaaaacactggctcctgtttctgccatcacaaattgggaagaagctaggaagatgtgcagaacattttctgggtagggtgggctgggccatgtccacataacaaaaaggaagccgacctttgaaaattatctagctcaggcgaccgaggaagccaaaccagataactcagactcaaaatgaatctcttccagagtaatttgtactgccagttcgtcagtgcttacacaaaacagatgttatgaaatgcagatttcagaggtcaataataaaatatctgcagggtatttccgtgatcatcgatacaagatttgtgctgaggaatgtggaatcttccaggacctaatcatgcactaataatttcagcctattcttgaatgtgatttaacctagaaaataaaatgctaaatggaaagccttattcaaaccgaaattgtacatgatggaactggtctattttctgtgacagtgcacttgcacattttggtgtcgcactttgctgaaaagttccttagatgggtttcagtcgaaggtgctatagaagtttatttgtactgtactcaaagtaaatgcattctctccagactgcaagactgcaagcacagtcaataagatgaatgagtttctcgaactcatttagtgccttgtctataatagtcccattaccaagtcccatgtaacttggcaacttttcatcgaggtggcctcgggaccgaataagcaaggagaaaatacagcttcttgccttggcacttcacgtaggacctgatgctcctggcgggctgtgattgaaagtaggtcttactgcccggccctctgaagccgccttttctaaaaatgttgtactttggaaaggcacttccgcattacaactgaaaaggcaaagccggactcaaatatccagttccgcattaacctttaggattttgcctctggatttccgaaccagttaactctattccctttctacctggacattttaatggaaaatggttgtggctggtttcctgtactttgtgtactgcccaagggataatagcttgacataggcaaataacaacggaaagagttaactctaagctgaggttctgtgcttcagttgccagaaagaatgcattaattagatgtggttcactagaataatttatctagaaatctaaaacctttcttgcataaagattcaagcccaaagaggcttctgccataaagaaaaacaatatggactttcatatggcttgtgagggagacgtatacatctcatcaaatgcatcgggctgaaccagctaagtatacacaggctgcatttaaacgggagaagtatcttgactctggcagtcaaatttggccaaagcaccactttatctgttcagatgtcaggttggtggagtaaacttgactgggctacggtccctggtccacgcatccacacagtgatggaggcggcctgagtctggtatccacggatgaattctaaagcctctgtaaatccccttaaaactagaagcaaatttttgtatctgtgtgcagatgtgggcttttgtgggaattgggtgcttagctttcatctaattctcagacaggacaattgaccttaagtgtttaaatattttctaattttttatgactataaacacagacataaatacactattttcgcagatgagctatcaatgctagtctttttccgttgttcccttgctcctgcaatctttccacattcacctgtattatcctcccttatcccagctgtcattccaggtaacccatagtaacaacatgatgtggatgattctgtacttttctcaaaactcatagtatcacatgtaaaatttgtttatttatactaatgtatatgcatatatttgaatttatagagtatttctggtcattgtttaaaaatgtgtcttctattatatacactctgtattttatttttcttattcagtaatctgtaatggaaatctgtttaagttagtacagaaagcaatttcttcgttgttttggctgcatggtatttagggcacggatgcgacgttacagtcctgtgctgcttagtgatgggtatatatttggagaaatgtgtcctttagtagtgatttttgttatatgaccatgataccgtgtactcacacaaacctagatggcagagccttacacacctgggctatatgacatacctattgctcctaggtaacacacctgtaccgcaggttactgcactgaatactgcaggaggttgtaacacaatggtaagtacttgtgtgtttaaacatagctaaacgtataaaatgtgcagtaaaaatatggtattataatcttatgggatcacggttagatatgtaggtgggccctataatcttatgggatcacggttagatatgtaggtgggccctataatcttatgggatcacggttagatacgtaggtgggccctataatcttatgggatcacagttagatatgtaggtgggccctcactgaccaaaatgtctgtagttaatcagtccctgctgcggtgggtgttcacttttcttcttgatcttgttttgtcagtataaacaacgtttcagtaaacatcattgcacgtatatcattatcaactgttgttctcattgttttggcaaagattcctaaagatggcattcccaggagaaaaagcatgttctaaaatttaatagatgcagtcagatgcaaagctcatatgataccagcattagataagaacacttttttacctgccaggttcggtggctcacgcctgtaatcccagcactttgggaggccgaggcgggcagatcacgaggtcaggagatcaagaccatcttggctaacgcagtgaaaccccatctctattaaaaatacaaaaaaatttagccgggtgcggtggctcacacctgtactcccagcactttgggaggccgaggtgggcggatcatgaggtcaggagatctagaccatcctggctgacacggtgaaactccgtctctacaaaatatacaaaaaattagccaggcgggttggcaggtgcctgtagtcccagctactcgggaggctgaggcaggagaatggcgtgaacccaggaggtggaggttacagtgagctgagatcgcaccactgcactccagcctggaagacagagccagactctgtctcaaaaaaaacaaaacaaaacaaaaaacaaactcttttaccttctcacaataggtttaatgcttcttttaattttttgcatgcataggtgctataaaataatatttgtgttttttgtttgtttctttgttttttgagatagagtctcgctctgtcgcccaggatggagtgcagtggtgtgatctcggctcactgcaacctctgtatttttagtagagatggggtttcaccatgttggtcaggctggtctcaaactcctgacctcatgatccgcccgcatcagcctcccaaagtgctgggattacaggtgtgagccactgcacctggccataatatttgatttttaatttaatttgcattttgtgactactagtgggttgaaacatctggtgaaagatctaccggccatttggaattgtctttttaggactttccaattcacaccctttgcccattttcctattggtttctgttgtctttttcatattaattttagagctgtttatatatttattataggttattaaccattaagtatcatctgcagaaaaaagtacaaaaattattttccaatattttaaagttgtatgacatattttggtgcaattttattttttggaaatacaattaaatatgtcttttatggttttttttctctttttttgagacagagcctcactctgtcacccagtctggagtgcagtggcatgatttcggctcactgcaacctccgcctcccaggttcaagtgattctcctgcctcagcctccccagtagctgagactacaggcacatgccaccacgactggctaatttttgtatttttagtacagacagggtttcaccatattggccagttaggtctcaagctcctgacctcaggtgatcagcccacctcagcctcccaaagtgccagcattacaggcgtgagccaccgcgcctggctgggtttttagtttagaagttttctccaacccccagaatatttttatggcaaatttttaggataaaatctttgtggaaaatatgtggagagtgaagatgtggatgaggagactttctacctatttatcttgaaggcttaatctgtaaaatgcgtcattttattaaatattaaatgacttacaaaaagttttatcccaaatttactgccactgtcaaaaaatcaccataaaaatcttacatatgccctactcaaaatgaacgcttcacctcagtactggtgaggggttcccaagggtgctatgatgtctcgtgctgacattttaaaacctactgaggccgggcacagtggctcatgcctgaaatcccagcactttgggaggctgaggcaggaggatcccttgagcccaggagtttgagaccagcctgggcaacatagtgaaaccctgtctctacaaaaaacaaaaaccaacaaccccaaaatacccaggagtggtggcaggcacctgttgtcccagattgtcaggaggctgaagtgggaggattgctcaaacccacgaggcagaggctgcagtaagtcgagatcatgccactgcactccagcctgggcgacagagagagaccctgtcttataaataaataaataggccgggtgtggtggctcatgcctgtactcccaacactttgccaggctgaggcaggcggatcacaaggtcaggagttcgagatcagcctggccaacatggtgaaaccccatctctactaaaatcacaaaaattagccaggcgtgatggcacacgtctgtaatcccagctactcaggaggctgaggcaggagaatcgcttgaacccaggaggcagatgctgcagtgagctgagatcatgccactgcagtccagcttaggtgacagagggagactctgtctcaaataaataaataaataaacctattgcgcatttgtttatcatcacccctgctttccctagcagcttagccctccatatgtcttagtgtttgcttctgccgggcttttggggatacaatttagaaagtatatttagtatcttcactccggaaattacatagcaatgtgtgtttactgtggtcgagaaagaaacaattctggcctcttaaatataaacttccacagaggatcacccatgcaacggagtggtcagcatccccttcattcactttaacattttcacaattatataacttagcatcacactctgttgttgttatagctctttggatccatgtaggaatttgtgtgtgtctgtatcttctgagaataactgacatattttgcttgtaatcaatgttaatgtatgaaatccattgagcaaaacttgctaaaaacaattgtttgtaaaatttttctttaaatgttgaacagaaaaaaaaaacacacagaaaattgtgttactctctttctttcccttttttttttttgggagacggagtctcactctgtcgcccaggctggagtgcagtgatttgatctcagctcactgcaatctccgcctcccgggttcaagcaattctctttcctcagcctcccgagtagctgggattacaggtgtgcaccaccacgcccagctaactttgtgtatttagtaaagatggggtttcaccatgttggccaggctgatctcgatctcctgacctctgggatcagcctgccttggcctccgaaagtgctgggattacaggcgtgagccactgcactggccctctttatatatgcatagatattgacaatctcattttttccctcatttttgggggcttaaaaataatgacatgggaaatatacagttactgggaaaataaaaacacgtcagaaacgtaccacagaggagggaaataaaattgctctccaactgaggaatgctaaggctgaggtcagagattgttaaagctttgtttgggaagttgaagaagagttttaaggctttgactccttcttccctttgaagacatcagagtgaacagagactgttttgtttcagaccctaataaaggtgacatttaaaaagctgtataaccacagagcttaggcttattcctgggagtgcaaatgggatacaccagtatttaatgcctgcattacaattatgccaaggtcaaggacagcttgacttctggatattcccaacccttgtgaaatactacctactggaatttcccaaagtgatatggtgtgtactatgggcattcacaggccagcccttccagcatcgttcccatgattggagccacagtctcttcccaagccccaggtggctggagatactgtcactgtcctcaaagctgcctgaaggagcaacatcactgcactgttccatgcatgaggctgccaaggccatgccaaggtttctccagtgcctccacctccatatgcttcccttgacgacagggctgtgagcacaactttcttgcagtgataggcagagagaccctctgccctgccgggctgtgctgccagctgggtgcagacctagaacactgggatcagagtcccccagggctctgctcatgcgcccgtagcttcctcaggactcttagcttcagattttctactgacatcagcttgaaaagataaactcttcacttgaacaattaatactttttttttttttgagatggagtttcactcttgttgcccaggctggagtacaatggcgcgatctcagctcactgcaacctctgcctcccgggttcaagcgattctcctgcctcagcctcctgagtagctgggattacaggcatgcaccaccaaacccagctaattttgtatttttttttttttttagtagagatgggatttctccatgttggtcaggcaggtctcaaactcctgacctcaggtgattcattcgccttggcctcccaaagtgctgggattacaggtgtgagccgctgtgcctggccttttttttttttttagacggagtcttgctctgtcgccaagctggagtgcagtggtgtgaccttggctcactgcaacctccacctcccaagttcaagtgattcccctgcctcagcctcccaagtagctgggactacaggcacctgccaccacacccagctaatttttttttttgtatttttagtagagatggggtttcaccatgttggccaggatggtctcgatctcttggcctcatgatccgtcaaccttggcctcccaaagtgctgggattacaggtgtgagccaccacgcccggccacaactaatagttttcaggagcgtggtggtctcagtttatacctaatgcaaatttcagtttgttggtaacaacagcagcagtgtgcatagatgcaattcagcccactactcacgcaacttctccccatgcttgtgcagagcagtttttctccttggagccacagatattgctccttttcatttgcatagctaaattattcattcgagtgatttcccagaacaaaggtatgatgtgtgtgtgtgtgtgggtgtaccaaatgttaaatatatatatatatgcgtgtatgtatatacctattatatctatgtctacatctaataacctttggtcaacagagcattgctctcagttttgaaagtattttcttcttgtatctccattcatatttcaaagatcaaagtgttttggacttctccactctccacttcataatcttccttcatttgcttaaacctgcttcacagattacccctgtgaagatggtatggcaggtcaatatccctattgaaaaaatttgttttcagctttcttgaaatatgattgacaactaaaaatcctatctattgaaggtgtacaatgtgatgttttgatatacattcacatgataaaatgatgaccacaatcaagctaattaacatattcatcacctcacaccatctcttaatgtgtggatttattctttcagctattttcaagtagataatgtattgttattaactccaagctgtatgtttcaatgtccagaacttaattatctgatgcctgcaaatttgtccccttggactaacacctctccattcccgccccacctcctggcctctggtatcaccctctgctccctgtttctatgagttacacttcttgaggttccacgtacaagtgagatcaagcagtatttgccttatctcactcagcacagcggcctctacgttcatccctcttttttttcttttttctttctttttttttttttttgacagagtcttgctctgtcacccaggctggagtgcagaggcatgatcttggctcactgcaacctccacctcccggttcaagtgattctcctgcctcagcctcccaagtagctgggattacaggcctgcaccaccacacccggctaatttttttatttttatttttattttttgttttgtattttgagtagatacagagttttaccatgttagccaggctggtctcgactcctgacctcatgatccgcctgccttagcctcccaaagtgctgggattacaggcgtgagccactgcgcgcagccggttcatccctctttaagtgagttactacgtgaacagtacttaggagagtgcctggtagcaatgagcgttcacataacttcagctcttgctgttccctttctcatctaggtctttgtagggatccctgccccatcccaccacacccctgctattctctcacacaagcattatgcagagaaagaagactcagctagaaggccttgctctgagatgcatcatgccagttctggaatccaaaggtctctccagtctttcccatgtacctggaactactggaaagagataccttgtcactaggtagcacacacagccaggaagtcaccgtgcgggggttagatgacagcatcgggctgtctgtccagacaatatgttcatggggtcaaaataccgcgctgtggtgtggctcagaacggcaggtctataccaggatcctgcaatgagcattgtgccacgattcggcaataaggattacaggggcagaaaggcatgatctctttcctcacctgtcataacggtcatggctgacattcctacagcaaaagacaggttaacaagagaggagcataacaaacttatttaatccaacttttatgtgacgcaggagccttcagaaatgaggatccaaacactcaggaaaaaccatttttgtgcttcagttagatgacggatggacagccgtgcagcagtgtgaccggacaggagggtctgatctgatggtaacagatggagacctgtcggtgcaggctcttcctggcctctttgcacagcgctccttcctcctcgtgtggggcaggaccctctagaatgagggtcttcaagggaggggagagagaacgactgtttaaggttttaaggctgtcttttggggagaggggtcctagtttgtgagacctgccttggggaagaggaattctggttgctctgactcgctttgggggagaaagagcagtgggaggcaggaggacgggagaaggtcagagagccactttgctgctgaggctgctcctgaggccttccaatctcctttagttcaatgtactcccaggccaagcaccacaattgcgggattgtttcctgagacctgtcaggacaaaagacccagtccctggtgccgcatcactcctagatcaaaagacaatataacagcattcactcattccaaccggttcaaatgccagtcctgcttcttacttatgtgtgacctaatgcagtgtctaaactgtttcctcctctgtaaacaagggatgttaacagtgactacttcacggggttgtagtgaagattaagtgtatgttatgtatgtaacatgtggtggattggtgcatggcatgttgtgaaagattaacgtgttaacatgtcaagtatgacggggtcttaaagagagcagggacgcagggcaggggagagagctaccaacccggtcataggataaaggtctggatggaagaggggggcagaaactttgtggaaggctgcagttgggcagcgctgcagttgggggaggccggttcacaggggtggacccaggcagcggtgcatttcctgcattaaccatgtttacttaagggaaatctttatcttaggcacctgctgatgtgaaccaaggtcccctcacggagcccttcctgctccccgtctgaacttcaaacaggccctgtccccagctcctgcggtttgtacttcctacctctgcgttaggcacttcttgcacctgccactaacctaatattcattttgcccgtaggacgtgttgattgactgcacggaagcttcacaaggagaggattttgcatctgtttcgttcacggtgttgtcactgtcatcatcagctgtataatggatgctggcacagagtaggtgctcagtatgtcttaacagggtgcgtggctgtgtgaattagtgggagaattgtgacaggactctgagtcaacttagggaggcacaagtatgcccctcgctggaagaattagggagggcaagtaagataaatgcactcctcttctgtgagggcttatctgtcaatggaagagatgccgtttagtttaccatatttcttttcagctctctccacccagagttaaacaagctggtcctcatagccaccatccaagattccaagtttcaactgccccatctcaggtgtgatgtctgtggaatattgagcctgaaacatttaacctccaaacctaaacttgaagaatgatgatggctatcacaggaaattacattctaaatggaacatgatacagaggaaattaagtctgtctcgctgtcttgacacatagacgccaccagtatctcctttagaaaatgtgcacttctaggctctaagctttatgaggacaagcaccacatctgcgccattgtgacttcggtacctggtctccttcactgctcgttacataggaggtgacaggaatgatttgattaatgaatatatgcattttagggggtcatctaactcaggtggtatattgagaaaaagacaggtctttttcatagcaggctattagtggcaaaagcctggattagaaatcagaaagaaaactttggctttagtcaaaccaattatgagaagttgactaaattcctcagtctcttcaacacttttatgtttgtggtataaatgaaccataaaattatagtttgtaatttaagatggaaaacatcacttatttttgttccttgagtgagtcagaaggtaagtgacctaaagcattgaaaattattacttttgttgcataaacgatattttagagaaccattaaatagtttatctgtaaagtagtgataatttctgttttacctagagtataaaagtaacgtgaattttgtaaactgggaaatactaataaaaagtaacctgttatattacatttcaactttctttatttgtccaatgattagtgcaattgcagaagttttgctttaatactctttcacctttttattggttttgttttgtttttgcctttagtactttgactttgttgctttgcagttacacagagttaagtttttctttgtgctgttgtctgtactaaattttggtgaactctctgtgcagccgcagttttagtggttcttgggttgctatagttaaatactttaggccgaacactttataggatacgcttattccaagtaaataactcagtaggaagctcatttctgcatatttctttactgcttgctcatctagtgtgacaaatgccctttcaaaagtttaataacaccgaatgcttaataccttgggcgaggtaaaaccaaattagctggaaccgcagattttgaatatttaataaagcattaatgaacaaccaaccaaataagaaacatacagtttgttgttttgacagacctcaaaccaaaaaactctttttaaattgctgcagtcttttcattttcaccattatggttaaaaatctaccagtaatttcattataaactctatttccagagagattctatttggcaataaaaattaattctgatttaagaagtttttttatgttgctgtaatataccacaaaattacagtttctaaattcatatgactgtagggaatatgagtctgctagcaattccctcccctccccacttttttttctcccacagtatggaagacaaatgaccagagagatttttaaaatttttctttctttggggctatacaaaatatttaatcagtgatatcgtttgttactcctgggcatatataaatatttgatatgctttcttaaaggaagtaacaacctgataataattactttcctgtgtaggtcttatctatataaataaattcaaattattaatataatccacaagaatgaacacattttgcataactgagagatactactctaagccttggatatttctgatccaaatccctacataattgtgtgcatatgttagtcatcataatgctagctgctgtaacaaaaaaatcctcacaaataacagttcatttgaagctcatgaagcagtcctggatgggggtgtctattgggaggctctctcctatataatcgcctaggcagctggtgtggaagagactgtcatcttcaaagactgtcataatggcttcaaagattgtcctaattgccttcatccctagtatctggaagagaaaacaaacatgggtgagtgtgtttgtgagttttatagacaagatctggaagtggaacgtgtcccttgcactcagatgtcattgactagagctcgtagccacaagggaggttgggagatgcaggctcgtttcttacataaaaagaaaatgagccaggcatggtggctcatgcctgtaatcccagcactttgggaggccaaggagggcggatcatgaggtcaagagttcaagaccagcctgaccaacatggtgaaaccccatctctactaaaaatacaaacattagcagggcatggtggcaggtgcctgtaatcccagctacgtgggaggctgaggcagaagaatcgcttaaactcaggaggcggaggttgcagtgagcagagatcatgccattgcactccagcctgggggacaagagagagacttcctctcaaaaaaaaaaaaaaaaattagccaggcatggtggtgcacacctgtaatatcagctacttaggaggctgaggcaggagaattgcttgaacccaggaggcagaggttgcagtgagctgagattgcgccactgtactccagcctgggcgacagagagagactccatctcaaaaagaaaaaaaaaagagagagagagagagaaaatgacaacacagatttgggagaacaatgattaacctttgccatagtatgcatgcttgattcactagttaagatcaaagtagtattgctacgtttaaactttcgatgtaaaataaaggcattggtgttttctgtctgttttttgtaaattatctactgtgggcaaatgggtatctagtccaaacttaagcaaagttgaattagagaagaagtctagttaaatactgtttatttgaaaatatattcaaagttaatctttttcctaggaatactgatttaaaaaattaaagttaccatgattgaatggatatctttgaggaaacagataatttaagatgtatttcatcagccttccaatactcctctgtaattgatctgagccatatgacagtgactggtctgtaatacacttaacttgtcatagtcaatgtcttggaaatcaaagtatttgtttatgctatagcttcctaaattaagtattataatggaagtcacatgggatgagacaatgatccctaatttataaaatatgaaaccaataactatctctttaaaaaaattgattggccaggcgcggtggctcatgcctgtaatcccagagctttgggaggccgaggcaggcggatcacttgaggtcaggagttcgaaatcagcctgggcagcatggtgaaaccccatctctactaaaaatacaaaacagctgggcgtggtggcaggcgcctgtaaccccagctacttgggaggctgaggcaggagaactgcttgaacccagcaggtggaggttgcagtgagccaagatcgtgccactgcactccagtctgggtgacacagcaagactccatctcaaaaaaaaaagattattataatatggttttgtcaagtagatcatttcagaaattgtgtctctagtgaccttggtaaatcaaatccttatttttagcaaattcattaagaacagaaacagaccttggaagtcctggaagctgctccatttgcttctaggacctgcatttcaccatgatccattaacctcctctgtaacattaatgagtggcttgtatgcatcagaaataggggcacgatgatgaataggagcttacggtctagtgaagggacacacatatggcaccatcaccctcttccactgcagagctggcactgcatacattcgtagcaaagagaaaagcaaaggatgcagggtgggctgcctacctttagtagcagaactgaaaatcagttcctgagtagatgtattggcgggaatgacacctagctgtgactggcgaaagattctcagtcctgggcccgtacatgctgaacaatgcactgttgtcatcctgagttcgctaacccagtcaagcatgcactggctgtttggtaaaaattaaatattcatcataggcagaaccatttttaaagcactaaatgataattcctaaggaaaactgtaattggcatttctattcttgaagctctgacaccactcatctctctctcttcgcttatagagtggggcatgataaagaagctcccccatggttccaaattctacccatctaatcaccagtgacaagcatagaggcacgagtggcagaaagaaataccaagggaccacggccaagctggttttaggggtagccttatccttcatatctgtatcagacagtcaataaagacttcaggctacctctcctcccatttcccttcctctccataggctatgctccaggcccattctctcagccaccatctcgtattccatgatacatattttttttttgtcactgcatctcatcaaaggttttctttcctgtgtcccacagcttggcacttactggagagctaatagtctaacctagccactgtagtatactttcaaaataaaggacgccttagaaaacgcaggttcacagtgctccaaagcgactccgctagtcaagatcttagagagcatggattactggtggtaaaagtaactgtgggatggagatcatcttagtgcctttggtagacagactcctaaaacagcctccagtaatctctacctcctggtatttatgcctgtgtaatctgcccttgtgggtggactgtaagtaataattcaattctaaaccaatacatacagcaaaataaatgaaatgctgcttatgtggttagtttatgaaaatccatgatttccagcttgttagcaggctttctctcccgccttcttggcttgcatgtaataatgaagaaagctgctgtgtaggaggggcccacatggcaaggaaccgagggtggcctctgctagcagacagcagacactgcagccctcagtctaggagcccacagggactgattgctgccaaaaatcactgagtaagcttagaagggaatctttcacagttcagtcttcagatgaagctgcagacctcgggctgaccttttttttttttttttttttgagatggagtctcactctgtcacccaggctggaatgcagtgtcatgatatcagctcactgcaacctctgtcttccaagttcaggagattctcctgcctcagccttccaagtagctgggattacaggcacctgccactgtgcttggctaattttttgtatttttagtagagatggggtttcaccatcttggccaggctggtctcgaactcctgacctcacgatccacccgcctcggcctcccaaagtgctgggattacaggcatgagccaccttgcccagtcgggctgacgttttgattgtaaccttgtgagagaccaagacacaggacactgctaagccacagagaaactctgagtcactaatgtgtgctgttttaaatggctgcgttttggtgtgatttgttactcagcaattaatagctaatccatgccttacactcctgcattgagatggctacacactctgctaacttgggagtgatctcctagaggcaggaacagtgtcttttgtattttaatatcattactacctaacaataaatacttgttaattgaatgtatgaacaaatatacttgtgtatgtaaagccactgatctccagtcctctgtactgttcagcttgggacaaaagtgtgttcttgtggtctccttttgcttgtggggggcgggtggaggggaaaggctggtaattccattatgttggaaagctaaagggatatgaccatgtggtcttctgcgtcttcataccagttcctgtcagaagccgtggcccagctcctgttgaagctgttctgcaggcctgtgtcctataacttctctgcacagcaaagttcttcactgtgtggtttctatcaatctaactgtcttttataattcacaatgttttagattccagaagcactttattggctgtatatatcagtgttttatctgcttaattatataataattacaaagctttatcactctatagatgtattatatgttgtattacagcaaaggaaaaattgtaaattcggaggcacaatacatgtgcaagtgtaaaacctggggcctgtgcttgtgttacttcatgtttattgttaaacagttaaattctaaagcccactctgctgacgttgatagagtgtgtaaactgataataacgaataataatggcaaaaatcaatcgctaggctttagggcttgcccaacaatggaagctcttgatattttgaaatgagggtatgcaagaatgaagcaaattcaaaccgatgtgtttgctttcagcacgaagaatatgaattagaaaaatctggaggtggagaaatggcatttgctgcctctctctgaagttaatattcattcagcaagaaaccactccattgtaaagcagatgtctggaggaactgagagatcctctggttttccaagcatggtgtggacacatcggcattgtaagattcttagctcttctgtttttcttgtattttgtagctgttttgaaatactttatgaacaaagaaagtaaaaatagaaataggtagaatataagagtaaaacatccaataattattggcatcaaggaattgaaatatttcctaaagtagaaaagctagaatgctctctgggggtttaatttaaattatagttttagtttttttaaacctgtaatcagtatacctaaagcaggtgtttgttttgaagataatagtttaaaaaggcttttctctgtgcatcgtaatcagggtaatatttgagtcattttaatttattttatatggtgattattagcacattacatgaacgtgctatacattcatacagaatgtatgacagaccaggtctgtattgttctttttattatagatttaactttgatataacaagttttgaagaaagaagagggttgccaattacttttctcattgaaattgaacatttaaatttctagtacttaataccatgaaagctgcataatggcaaaaagcttcattattcaccagaaagaatccgagagcagaataatacatcccttgaaaggataattatttcaacagaattagtgcatattttgtctctaaactgaggatagcggtagaacttaactcatatggctggagtgctagatggtacttggtattaaatcaaatgggggttataaactgcttagagcagtgctaggcacacagtaatggcttgctcacttcagatgccattcttctgcacaagcgtcctcatcttgctcatgcaatactcagatacacacaattacacctctgtagctcatctgatcttctctacgaacccttgagttcattttccagggcttctgtaacaaaataccacacgtgtgtggcttaaaacatcagaagtgtattttctgacagcactggaggccaggagtgcaaaagttagtcatcagcagggccacgcccacctccaagactctgggtagaatccttcctttcttcttcctagctcctggtagtgaatgttaattgggggtgttccttgactcacagccgcatgaccctaatctttctgtcatcccataaacgttctccctgtgcgtctctgtcttcttacaaagataccagttaattggacgaaggtccatcctactccagaatggcctcattttaactaattatatctgcaacaaccctatttccaaataaagtcacattcttaggtaccagggtttaggatttcagcatatcttcttggcagacacaatttaaccagtaagagcccccatctgctgacaaattttttaaagcatatataaaaatataaagtacttttggggccaggcacagtggctcatgaccgtaatcccagcactttgtgaatctgaaggggaggattgcttgagctcaggagttggagaccagcctgggcaacatagtgagaccctgtctttaccaaaagtttttaaaaatcggccaggaatggtggcatgcacctgtagtcccagctacttgtggggctgaggtcagtgtaagcctagcaggttgaggctgagaatcaagtggccatcaacggatggtttatttctggactctgagttccttccactaacctgtatgtctatccttggttggtgtgtgacactgaccactggaatggtgattctggctattagtctccactcctaaatccacataaactgcagtctcttctcccagtctcagccacaagtcctcaaagtctgtttgcatctttttttttttttttttttgacagagtcttgctgtgtcactaggctggagtgcagtggcgcgatcttggctcactgcaacctctgcctcccgggttcaagtgattctcctgcctcagcctcctgagtgcctgggactacaggtgtgcaccaccacgcccagttcatttttgtatttttagtagagacaaagtttcaccatgttgggcaggatggtctcgatctcttgacctcgtgatccacccacctcaacctcccagagtgctgggattgcaggcatgagccaccgcgcccagcctgtttgctttgcatcttttttataagaaaacatgccttttttttttttttgagatggaatctcactctgttgcccaggcaagagggcaatggcacgatcttggctcactggaaccattgcctcccgggttcaagtgattctcctgcctcagcctcccgaggagacgggattacaggcacaccctccgcacccagcttttttttttgtatttttagtagaggcgggggttcaccatgttgtccaggctggtcttgaactcctgacctcaaatgatccacctgccttagcctcccaaagtgctgggagtacaggtgtgagccatcgtgcccagccaaaatatgatattttagattcatttatttgtcaccctttgtaaccaactctttgtcctttgtttcaacttatagagatgagctgggatctaagtagatctgcagcctccctcttgtactatcttgggaaattgagctgaaaatccagaatgccttgtttttccgttcctcactggatgtttctaaagttttgactgcctttcgaacaatgacattttcctcctgttctactttcttcttttcctctcatcacttttcctactccacaacctgccatgcagagtggaaaatatggatggaatatttttaatttgtttagagtgcttatatgatttagtgtttaacagcttaggttctatagctagtcaccctagcataggaaactgactctgatattttctagttgtgtgtcttggaacaaattatttaacttctgttttccagtctttcatggcaaactaatattaatgaattcagtgaaaatataggagcagtaaatgattctgtacatgtaaagcgcttggaagagccctggaaaatggtaagtactcagtcacctcaggctgatactaactagcatttctgaatgcaactgaacttcatagcctcgcccgggctttggctttttgttgtcttgacagcagatcttcctcctgactccaaggtattcattgtccagttttattggaagacagggtaagggtaagagagatggaacagctaactacaaaggaaaactaaatcaggaggttatgtaatcaagaatacaaaactgttctccaccgggtctggtggcacgtgggaaaagtacaaagaaccaagaagaagccttagagtctagagccacaggaaaggctgtgctgatatattcagagggaaatcagtaaagggaaagagtgggaaagagtctacattatctttaaggctcttagactctttttaaagacgtgcacatgtagtcagtgataggccacctaaatagtatggtcctatacgattatacagagagctgcacattttctattacctcatggcatcatagctgtcataatgacatatcacaaagcattaccttttctatgttgagatatggtaatatgcacaaatatttaccgctgtgttacagttaaccacagtgttgagtacaggtttgtagcctagaagcagtagactgtaccacgtaacccaggtgtccagaggctgtaccatctaggtttgtgtacactctgtgatgttcacacaaggacaaaaattgcctaatgatgcatttcttggaatttgtccccatcattaagcaatgcatgagtgtatatggtgttgaattttttaacttcttgaagtttgcagttaagcacaatttataaaataagaacttttcgactcagatgaattatctatgcaacataagcagcaaatagttaaggtttcataaatagcaaactcaactgtcgatattttaaatgttatatatgtttgtttttgtctccattcagatccaatttttggaactgaggaagactcattaaagttggaaaaagttctaaatgatttgtcaaatatattaacatgaactgtggtgaataagaagaattatatctttatttgttgtacaaagggccttagaatagatcagtagaggcagttatcaggaattggagtcacatctgagtttctcttctgaggaacttgctttttaggagggcttgtcctaaagccctcatttagccacattctgtgattttttatttgaattccaagagtacttgtgtaatcagatgcctgtgtgacagtaagaactctgggttttcattagtagtatcaggactttctttcagaaacaatggtacttggagttagcaaagtaaagactgaagcctatctactcttcatttacgtacggtactcccccatcctcatgctttcactgtggtctcaagacacaagcaatgtgacatcttaacttacataaaaggatggtagggagcattgttggaataaatggaaagtgagtagccgctgcaaatgactgtgactttaagttggtgactcttcagaacagaggtctccttttatcttctttttatattacttggtattttgtgcagctacttagcacctgtccatgaggactgaaaactcttggcttaacattgaagaccagatttatgcatgacccatatctctacttggggaaagctggaaagtgtctgaagattgttactgggaggctctgttcgatagataaaaaaattcaagctgcatattgaagagctggggagaggaaaataaaaacaaaacaaaaaaataccctaaaagatacaaaatattaaaaaaggaatagaaaggaaaagaaaaatgcaggctgcaatcagcctgggacattcccttgttcaggagagtaatggtcattatcagtatcaaccgcagtagctatggctctcaatacctcacttaactgggaagtttaatccaaatgtttgcaacccctttattaagccaacttagaagcatcctcttgaactggaaaggattgccaaagaatattgtaattttttgattgaaggaaagtttgtatacaattatttccttatattgatctcaaggcacatactagatggtatggatatgtcaataaagcactcctggccgggtgcggtggctcacacctgtcatcccagcactttgggaggccgaggtgggcggatcacctgaggtcaggggttcgagaccagcctgaccaacatggagaaaccctgtctctactaaaaatacaaaaattagctgggcatggtggtgcatccctgtaatcccagctacttgggaggctgaggcgggagaattgcttgaacccgggaggcagatgttgcaattagccaagatcacaccattgtactccagcctgggcaacagagtaagactccatctcaaaaaataaaataaaataaaataaaataaataaagccttccatgtatccctcaggtagaaggcaaactttatttagtgtcagacaaatgagctacattactttttcccttgattattctgtgtgcaaagatgtagggagaagttatttttatctagttcaatctcaagtcacaatgtaacgcactttgtctcacagctatgtgctatttattctgtgtattaaattcttgtaaaccacgacgtgactcctaaactaagcaaaatgcagcatgaaatctctagtgcctttctcatttctacgactacaagattccaactcttcacatttttctgttgggaaatattcatagtattcatatttagctatttgtataaaaaatagcacagcctctcttgagagtttcaatcaatattttttagctataagtttccaagaatgaaatcctttacttaacagaaaatgttttcaggatattataccaagttacgtgaacataaatttcatggctaagtcctggtggtacaagggacctcagacagtatccaactcaattccctcctggtttagggaaagaaactagaccacaataaaataactgcatttccttaggtcacattgccagctgaaaagctagggcatttaaaatgaaaatctagagtggtactttttgggattatttattatttctatgtttaataatttcctgcctcatttttgcctttctctacccaagcattttataaacaagaacatatgcaataaaatattaaattataaatgagtaaaaacaaaaatataaatagaaagtcaaaaccaagaaaaaagaagaatataaaatgcatgctgaggtcaagagtttgagaccagcctgaccaacatggtgaaacccatcttcacaaaaaaaaaaagaaaaaaaaaagaaaaaaagaaaacaaaaggcctggtgctgtggctcacacctgtaatcccaacactctgggaggccgaggcgggcagatcatgaggtcaggaggtcgagaccatcctggctaacacagtgaaaccccgcctctactaaaaatacaaaaaattagccgggcgtggtggcgggcgcctgtagtcccagctacttgggatgctgaggcaggagaatggcgtgaacccggcaggtggagcttgcagtgagcagagatcgcgccactgcactccaggctaggcgacagagcgagactctgtctcaaaaaagaaaaaaaaaaaaaaggaattatcgtccacatcggggctcccaaacgggtttgctggaagctcttgcaaggccattgcagttccttctgccatcgctcaccctcgcttctctccctgcgaccgctcccctgactgctgcctccaggggtgagtttgggctgtttcagaactttatgtgtatggaatacagaaggatgcttcctctttagctgggctgctgttgctcaatagtgtgcttttggggatcatgtgcagcagtggttcgttttcgtttctgaataatatttctattgcatggggcatctaagaatctatcggcagtattgatgatgaatagagagctttcctccagtttcttttactgttatgcctaatactagtatggataacttttgtgcatttctttgggttcccattagcacacaactcagttgagcatatccctaggactagaactggtgaaccacaggaaatgtatattttactttggtaaacaatgccaacattttccaacatataattagccctcctgcagcagtgtaggagatttagttctaccacatgctaggcagcacttggtatgactttcttttaaattagatattctggtaatggtattacattgtggcattggttgacattttactgatccctaattaagttgagactcttcatatgtttgccggaaggctgcccaagagagttccgttgacatcagttgtcatggtaaaataatcaaccgctcctctttccacgtcctaaagtgtccctgattggccatttcggtcttctctttggggtctagccaggtttatgtctttcgtttatttttatataaggttgtttgcatttttcttattgatttgtgggaatttcttgtatattctgataatgaactttcagttatattgatgacatatatcttctcctactttgcagcaggatcttgataaacagaaggttttaattcaattctaattctcagtagtgatttttgggtcctgtttttgtccactttatggacacatgatatttttctattttcttctcccttcaaattgaggtcttttattcttctgcttatggctaacgtagaagtcaatattaacttttttcacatagatttccaatttatgttcacttattaaaacactgcttttccccacaataccatctttgctatacattgaatatctatacctgttttttgtgtgtgtgtgtgtgtgtttttttattttttgaactctctcttctgttcctgtggtctatttattactctttcaccaataacccactgatttgaatagttcaactttaaaataaggtctgattgtcagttttgtaagccctccaactttgttattcaagattttcttagccattcttggcctactgcattgggcatttatattttagaatcagtttatccaggtgcacaaaaaaggtggagcttctcattggcgttgtggtgaaatttgtaaatcacattgggaacattgatattttgcagtactgggtctcccagcctagaaacaatgtatatctttgcattgattttggtcttctttaatatctctcaataatattttgcagttttcagagaaaagatgttttatacctttatttttaaaattatttatttattattattattttttgagatggagtctcactctgttgccaggctggagtgcggtggcgtgatctcggctcactgcaacctccacctcctgatttcaagcaattctcctgcctcagactcccgaatagctgggactacatgtgcacaccaccacgcccagctaatttttgtattttttttttaagtagagacggggtttcaccatattggccaggatggtctcgatctcttgacttcgtgatctgcccaccacacagtcccacagtgctgggattacaggcgtgagccaccgcacctggctgttttatacctttttttaaagcccatcatagactgcatgtatgacagcagtcccataagattttaaaatactgtatttttgctgtaccttttctatgtttagattcttttagatacacagatactgaccattgcgttacgagtgcttacagcgttcagtgcagtaacctgctgcacaggtgggtgtgtagcctaggagcaataggctgcaccacacagccgaggtctgaggtgtgtagtgggctacaccatctaggtgtgtgtaagtgcactctatgtttgcacaatgacgaaactgtctaatagtgcattgctaagaacgcatcttcatggtgaagtggcacaaaagtagcactgatattttcaatgctatttttaatgaaatttaagaagataattttctaattgttaattgctggtatacagcagtcacttggttgtgtgtattgacatatccagcaacttctccaaaatcacttattaattacatgttcatctgcagagccttttgattttctatgtgtataatcagtcagagttaagcatgccaataccaggagcttgaagggtggatattggaccggaagggtctaaagacgagccgcctgctgctggatagtgcacggttcaggaagtttgcctgctctcactgctgaggaagtccacagccctggcgtggagggtaggatagtcctatgcacctatgatgtgatgggattcatcaccctgaagggagcccgcaagtgctcagcgctgaattcctttatgacacacagacctgtattttctgtttgagtcattacagaaaaatattatttcagtggaaagcttgagattaagcaacttcttctgttgtttattttaagtaaatggaacttgacagaatgttttattacagaggcccagtaactaccagactagtgaataaatttcgtgacgatcaccgtaggaaagtctagagtctttgaatgaaaaattgtcatttttacaatgagaagcaagaattttgaaacattaagtcacaattttccagtctataatcatcgatcaactgcctaattaataaataaccttttaaatggtttggacttcattttggttagaatcacttaggcaaatggcaaatattaatgtgaaattagagctcgcaagtaagtagttatgaataatttgatagattataacagcccttttgtaatattttaaatcactcttattgcagttagcagacaataattgtcagagtatttgcatattactttagttaacacatgggctgttttaaaatgaagtatttttgctcttatccttccactggaattaatgggtgatgtcatgtatttgctttgcttcttaccattgtattgattttatcacctgattgtatactgtacaacataaaattattattatttttgccatcaataagaaatttacttgttttaaaaaaatccaaatgctttttaaaactagtgtaggggaagaaaatatacctaatgatgcctgctcacttggaacctgctttttagaaagcagcacgtagggttgagataagctgctgtgactagaatttgtaatcttactcagctggtattcaaagacagtaaatgtgaaggggctactgaaagcaatgaacttaataaccacataccagagaggacattagctgtgatattacagatgaatgcaggctgctatgtaactttgtgtctttgctttttaaagtgataaatggaagccctgcgaaaatccgtgaggtgagcataagatagccgctgactctagaatgaacagtattaaccccactggtttggcgcatgatgaaatgaaggacagatccattgtgttttcagtaaaggacaggatggtatgtaaattcagtgtcagatcttgatatttaactcaacagctaaaatatttccacaacaacttcagctctcagaaaaaaaatgtaatcctaatatttccttcaattaatctaaattcttctttaagacaaatataatttaaacttgccataaaaatgatgggtacttgtgggaacattcaatcactcctattttaaaattttgtaattttttgtgtcttattatttataatcactttaaaataactataattatttttctcaaggtttgacacattatagctatttttaacatcattcaatctttactgtcaggtaatttttgtaaaattgaataatatacaacatatgagctcaagatattgattagaaaactaaattattataattatggttactcgatttgcaatgagatgttaaatttcttctttggtatttagtgagacttcaaagattctgtgttctgtatatggtatattatagctcacgtgtcttaattttattgataggtttcaatacctctgttttttttgcctgcttgatataccactttctgaaaagggtattttgtaatctccaactacaattgttgatgtcatgatttctccctacaatttaattgttgcttgatacactgtaatcctatagttagttacatatgtgtttgtttgtggtaggcatggtggagaatcagttctattattccctgaaatattttatacatatttaacattcttttttccagcatgacatttttactgtaaaatctttgtcagatactgagatttctactcctgccttcttttggttcatattaccttagtctctctttttccatcctttgagcctcagttatcctgtttttgatatctacctcttccttttcctgaatcagaaaatactttaacatatatttatgtcctatggtctactggtccacacccccaccacagctatatcatattgataatgtcttcattttagttttggattaacttgaatacattttcttttattttgtcctggctttattttttttttagacaacaatttaaaaaataacttctactttccatattactgggtataacctctactttctatatcacttataacatacttgaatattgtcttcaatttcttgaggatactcttaagtacatatctgtccattgcaaacattttaaaaactgtatgcctgagaatatttttattacagtcttacaagtaatggactaaatagctgggtagaaaattctagctaaaatgattctccttcaaaatggtaaaaatgggtttccattatctgtttgcattcaatgtgttggtttgctcatttgtagatgatcttttctatttaaaagttttttgaagtttgttcttgtatacaatattttcaaattttcctagaatttatctgagtgtgcttttttttttcctttcagttgtttggtcctctgtgagctcttttacttaagatcattcatctttcttgaattctgagaaattcatttccattatttcttatatacttcctcagcttcatttttatttctctactcttgagactcataatttcgatgctggcacatttatttctagcctgtatttctcttagattttctgttctatctcctctgtgtcctttattgctgccctctggaaggtttcaccacttatcttacgtctatcctactatttatatgaaccatttcttcttcatttcaactgtgacattgttcatacttacatttttacctagttcaggtttagagatgctttgctcctgtttgataccgttattgtcctccctatctcataagcatatttaccatgcttagctgagctccttgatctgtgtgttcttgtaattatgtttctgatgcatagattgtctcaaggatcagttttgaacttctccttctgtcttttttttttttttagacagagtttcgcttttgttgcccaggctggagtgcagtggcacaatctcggctcactgcaacctctgcttcccggattcaaacgattctcccgcctcagcctcctgagtagctgggattacaggtgcctggcaccacgcccagctaattttttgtatttttagtagagatgaagtttcattgtgttggccaggctggtcttgaactcctgaacctcaggtgatccacctgcctcagcttcccaaagtgttaggattacaggggtgagccaccgtgcctggcctgaacttctctttctatctatactctttctctggtgatctcatcctgcttcatggctttaaatattattgctatggcatgattcccacatgtttacccccagttggaacctctcactgagttccagactcagatatcccactgcctatttcttatctctgctgtctgtataacaggcctcttcaacctcaatgtgccagactgacatccaagcattctgcacatgtgccagctgacctgtcgtcttctccatttcagtgaagacatttcattcttccagttattcagaccaaacgtctttctaccttccacattcttgattcctttctttcgtacatattctgcatccagtttaccagaaagctgttggctttacactcacagtatatccaggatgtgaccacattataccactccactgccttatctctgaccccgaccaccacgttttgcctgcgttggccccgtagccggtcttcttagtgtacttttgcctctttctactcaacacagcagacagaggagagtctgttagcaggcaggccagatcatgtcagccttttgctccaaacagtctaacagctgtgtctcactcacagtgattgtcaaagcctcgctgtgacctatggggctctacctgatgcccatcccccttcacctctgactcaaccctctgacttcagcctctacctctctcttttactcaccctgttttgcccacattgatcttattcttcctcaatatgccagacttctttcaggacttctgtcaaaagtcatctttcttccctcacccccatctaaaatttcaccaacattgttgaccattttatagctcccctccctaattcacttttctttcttagcatccatcacaacctaatattatatatacctgtttatcctatgtatcaattaaggtacatttacatacagtaaaattctccctttttcgtatacagttttgtgtgttttcacagatgtatacagaagtcgaaacaccatcacaataatgatataaacagtctcattgtcataacacactgccagactctttctgaaactggctgtaccattttgcatttttatacaaaacgtgtgagtttcaggtgctcaccgctgacagctgcaattggcattatgagggttttctttttttttggccattctaattggtatttagtagtatcccatggttttaatttgcatttctgtaatcattaatgatactgagcattatttcatgagctcgtttgccattttgatgtttttcttgataaagaatctgtttgaatattgtgcccattttcttacttagggtttttcttattaaatttgagagttctttatatgctctggatgtaaattctttatcagcgaaatgatttgcaaatgttagttttcagtctatagattgtatttttactctttttgtttttttttttttttgagacggagtctcactgtgtcgcccaggctggagtgcaggggcgggatctcggctcactacaagctccgcctcccgggttcccgccattctcctgcctcagccccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccatgtctggcctgtatttttactcttaaaagtaattttcaaagaacggagatttttacctttgatgaagtttaattatcacctttttcttttatggatttaatcaaagttcaaccacaaatgtaaacacagtagaaaatctatctatctattgtctatctatctatgtatctatcatctatctttctatctagatcatctattctcgacagcaagagagaaagagatttattacaagaaattggcttacataactgtggaggctggctaagctagttcaatatacgtagggcagacagtcatgaagatgaagcccctcaacaagttgaaccgtgggcacgggcgtgggcagtatttttacagaatttctactctccaggtgtttattcctgatatatagaaatctgattgatgtttgtacattgaccttgtgttttgcaaccttactgaagtcacttattttgttctagcagcttttattgcaagttctctgggattttgcacaaagacaattatgctgcctacacattgtgacgtgtttctttctttccaatctgcatgccttctgtttctttttattcgcttattgtgctagctaggacctccaatgtcatgttaatttggagcggcttgattagcgtccttctgttgttatatatcttatgtactgacttcccccgttcctcgccagggttagcaccacagggagggatgtggaggtagggctgtttctttttaggattcttggctctttctccaatgccagtaacaacgctctagtaagcagtcaataaatatctgatctttattatgctgtttagtttgttttctttctcttgagggagttttagttcttgtcttggaatttgggcctgtgaacacatatttgcaaggtcataccacgtcctaaagaccagaccccgcttggtgggtttaggaaagagagggagggtgaggcccagtgtggagagcccaggcccctggaactctggtggaccactgccatctgctgccactgcttccagcacatcacggcccttgggaagaagtggtgctggaggaggccccgcctcaggggaaatgcaccagtctggggacttggaggaagaggatggaagggaaaggtctaagagcaggtggccattctcgctgatttttgccccagctaggatttcctaaaccttcacgttaccccaaggacacctgcataggtggtgtgggctgtccttagcatttttgcagtgtagcgtcacgcaggaatcatcgaaaagcattttctcccaccttttgactgctccatccagtgactatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctatgcccaggctaccaccttcagccttccacccgcctcctccctcctccctgccacagcttttacttttctcaggtattccctctctttccttttctttcttaataactttttttttcttttttttgagatggagtcttgttctgtcacccaggctggagtgcagtggcgcgatctcggctcactgcaacctccacctccctggttcaagcgattctcctgcctcagcctcccgagcaggtgggattacaggcgcgcgccaccacgcccggttaatttttgtattttagtagagatggggtttcaccatgttggtcaggctggtcttgaactcctgacctcgtgatccgcccgcctcgaccttccaaagtgctgggatgacaggcgtgagccaccgcgcccggccttaaataacatttttaattgcaggaaattccaaatcgatgtgcagagaatattgtcatgcccccatgtccccttcctcccagttaaacactatttgctcgtggccaacactgctaggctcctgatcgatgccgaaagccacctcggggcatcacaccggtggtgaatttgcaccgcgtcagtttagcaaagccgctattgcacttcctagaatttcttctgcggcacagttccagggagcctggcccacaggggagctgcgtgagatccggaaggccgcagagcgctgggccaggttgatttgatgcgtggggggtccgtgcggggcatgaggctgccgcttccagacatgctgttgcttctcttccgtcacaggcagagcgggccttgccgctccccgtgctccgtgagatcctccttcggcttctctggtttctggcccaggccagggtctagctccatgtgaaaagtcaccttctcctgcaggcacctgcgcattgagggtgaaggcttgaacgtggcgagagatgaacccggctcacagcttgtccttgtgtgggctctggcccattctcccaagttccagtgtcgcccctgttcacccgctgtacatcatgttccctgcccagctacccgcctgaacactcagtctccagcaccagcagcagcagccccaccagcaccagcagcagcagcagcagcagccccaccagcagcagcagcagcagcagccccaccagcaccagcaccagcagcagcagcagccccaccagcagcagcaccagcaccagcagcagcagcagccccaccagcagcagcagcagcctggcataaatggtgtgaccagctcccctaggacccttactgtttacctctcctaggggttctgcttctctcattgaacgcttactggaaaaatatcatttcatctataaatatcagtatggatctccaaaaaatacaaactcatttaagtaacgaaacctgcatgtccttttctaaaacacacacaaaattaaaaatgatttctctcgagtctctttcaccctcccaaacacactttgagaatctattttcccagaactgatctttgggggagaaactcatgtaactcccatcttcctggcccactaaaatataccatctgatgaaattctattagcatattattgttttaaatactggtatctccgatagagggcagatatcttgtaaaaagataggctattataaattatttgtgaaaagcattggcttgtctagaatatcttttgattgttttatggtcactttaaagtcacttttaaatgtatttctttctttcttttcttttcttttttttttttttttgagacaaagtcttgttctcttgcccaggctggagtgcagtggcacaacctgggctcatagcaacctctgcctcctgggttcaagcaattctcctgcctcagcttcctgagtagatgagattacaggcgcccaccaccacgcaaggctaatttttatttttatttttagtagagacggggtttcaccatgttgaccaggctggtcttgaactgttgacctcaggtgatccacccacttcagcctcccaaagtgctgggaatactggtgtgagccaccgcacccggccctcccttcttcttcttttttttttttttttttttttttgagacagagttttgctcacactgttgcccaagctggagtgtggtggcacgatctcagctcactgaaacctctgtctctcagattgaagtgattcttgtgcctcagcctccctagtagctgggattataggtgcccaccaccactcctggctaattcctgtatttttagtagagatgagtttaccatggtggccaggttggtctcgaactcctgacctcaagtgatctccctgcctcagcctcccaaagtgctgggattacaggcatgagccaccctgcccggcctaaatgtacttatttcttaatgatattagaaagtttgtatattaatgtgttggcacagagtatgcacctatgctagtatagggacaattattgtgatggatataatttaaaaagccctgttattattagggaatctaatatattggtattggtgaaatttcttgataaaatttcctggattttactccatcatccattaatatttgactgaatttatgagccactagaaaagtaagtagattatatctgaacctgttgacgtaatgattgtgaatctgtttagcattggaagtgacttttgagcaaatcagattgtaattactaacttggtaatcaattgatcattgttcagggagattagtgtaagatgtccttccataatcagaaactgaagtagtcagtttcccagcatttatttttatcaatactagtagcaccaaatgatgctttatagcaaaagcaagtaaagaaaagagaaaatatatcctttttggaatttgaagagagttttaaagttagagcccaaggttgaaatagccatcacaaaggaaccgaggatgaaattaaggagtaggtcagggatgacattaaggttttgataataactgaaaattagaatccttgccctgcaagaaacattcccacacacaagcaggaagactgctacacaaaacccatttgttgttttacaagacacacatctgctaacatattgtatttggttgccagttaccaggaatagttttctgtttgttttataaccaaaatgtgatgattactctgaattaaggcaggaagaaagcttgttggttcaggttttatggcaaagaagttggtactaatagttaaggcccagactcctaacgcatactgataattcttaccttgtctatgtgtggtgaggagattcttccacagtcttagaatttaggataggattacaacgccagtgtgctgactataatgagcaatcatttatttttcaccagaaagggaaaacaacctttctgagaaatatttgctggaagcctggaaattaaaatcttatgggacaaagtaagatcattattttcctccaatatgcagacttgattatatttctagccctatttaaatgtatgaaaaatcagtcatgttattaatgattatttcaagttgttccatttttcagttaaactgattatgtgtaataattttagaagagtggcatcattaccgcagttaaaattcatagactcttcctgtttgcctgaacatttctaagcatatattttaaaaaataaaactattcaaatttttgctacaaagatgtttttctaattgattgtcttgtttctgtattgtaaaagcattttgaaaaacattttttagagtttaggtaagtttagctgtatattctattatttacttattggcaagatgttaaaaaagttgatatttcagaattattgaaacatagcttgtgttcttttttttttaaacagagtctcgatctgtcgccaggctggagtgcagtggcacgatctcggctcactgcaacctccacttcccaggtttaagtgattctcctgcctcagcctcttgagtagctgggactacaggctgcgccaccatgctcagctaatttctgtatttttagtagagacatggtttcaccatgttggtcaggctggtctcgagctcctgacctcgtgatccacccaccttggcctcctgaagtgctgggattataggcatgagccactgcgcccggcccatgtgtgttctttaataagtgaataaagcaaacataatatggtttttagaaagacatatttgtttagtttgtaaattaacttacatgaaagcattgcttaaaatgtcctaatgtcatgtaaagacttcaaatccatttagttattaaattcttccataaatatttaaattatattaatgtataatatccaacacccaatccaagaacatttatatataattggatacaagcattgaaaatgcttttgcaataaagtaaaaaaaaagtttttgcacattttccaaggctaaggaaaacttatatagaactggagaagacaatgttaagaggtgcaggtgaactaatataaaactgagttgtagttgtcttacgttttccatccttcctcactcaaggctacgggaattgcagccacttaattgagatttatttgcaacacactattgcaagggaaataaagagtttagctggagtcaccttttagtttcacagtttaatctattgttgttcacatgatatgtcttctccagctcatgacgtgtcctgttcttccaggtcctaaagtaggatccccagagaaaagcaaagtcagtccgggcacggtggctcatgcctgtaattccagcactttgggaggctgaggcgggcggatcacgaggtcaggaatgtgagaccagcctgaccaacatggtgaaaccacgactctactaaaaaatgcaaaaattagccgggcgtggtggcgggcgcctgtagtcccagctatttggcaggctgaggcaggagaattgctgggacccgggaggtggaagttgcagtgagccgagattgtgccacttcactccagcctgggtgacagagcaagactctcaaaaaaaaaaaaaaaaaaaaaaaaaaaagcaaaatcaaagaagataaatacctatgcccgtatttgcacatgggttaaattcctcctgggacaaagggagatcagtcagtcttcaacagtctggagcagtgtgttaacattatagggtggcagtcatatttatgctacaggtcaaaagctaatagccactgtagaattctatccattttaagggaaaacttagtcccataatataatatgatgtaacctagcacaaaatagcatagaataacacaacgtatcaatctataatccaagtaatagccaacaaaactaaagagtttacaatcttgttatattttcttacaaacataaaataattcaacatttctaacattttcaaatagccccttctagtgaatagcagctgtttcaaatattacactcttattgcaaagtgtaattttgtattacctaatgtcataaaatacagaaacatttgactaagcctgtcagccaattaaaaaaatatatacacctagtgttttcattatgtacaatggagtttataaataaatatgtaatgagaataaaatctaacttcacagtttgctgaacttttgaccaactgtttttgggtaatttggatatagactatctcctcattattaattcattcaaaataaaaattaactaaaaggtataaaagttatttattcatttaactggcatacatgtatgcccatgactgccaagcggtcgactaggcactgagtattacacaatggtaaataaacaggcaaaattgtagtttcctcggtggaaatcagtctaatgtagtgctacctactgtaattaactagtagagtgtatatgtgtgttttgttttccttgtttttatatagaacaaaaggaaaaatacatcaccatgataaagaccaagtctttcttctctctttccccgtttctagaggattccagaaaagtgatgagtgactaattttgggaaacatggcttcatcgcaggaaacaggtgaatacatccccatcctgtgtgggaaggaaacaggacagccattgttgggtggcagaacctacaaggggcattaccctgttgatttactcactacaggcaagaatcccaaatgcaggtgggaaattttactgggcaccgatgactcataagagtccattgtagttaatagaagtaaagccagaagtcaccttagatcatctactgaccacatgggaaaagctgaaataaaaatcataacactagaaacgctttactcaacctctgctgatctgatttattgaatcaaagctttcatttgcttgagatgtgaaacatactgatctcaacacactgaccagggtctacgcagtggtgcatacctgtggctcctggaacacgtcctctctaagactcccacatccttctattcctgcctggtgacaatgcttaataagaatggttgttcccaaactgatttacgttggttatatttcataattacaaaattttattaaatattatgtaagtaggcagggcatggtggcttatgcctgtaatcccagcactttgggaggtcaaggcgggtggatcacttgaggttaggagttcgagaccagcctggccaacatggtgaaaccccgtctctactaaaaatacaaaaattagccgggtgtcgtggcacacacctgtaatcccagctgcttaataggctgaggcatgagaatcacttgaacccgggaggcggaggttgtagtgacccgagattatgctactgcactccagcctgggggacagagcgagaccttgtctcaaaaataaataagtcaataaataaataaatattatgtaagtaacaaaatgagtgtggaaaagaaaattgtttctataccagctaagtaaaatggattggaaatatttgatgaagcaagtaggtaagaaaatcatgagtggtgtagaaggcacgtgttacgaaggagggtcaaaccccagatgggttctgcattcagatcgcttctcaagtggctccttttcaaaggaagctaaacttgaattcatagatcaagaattacggttttagtttaggtcagaaaaataatacctattgccagtcagaatcacatatgcaaaaggcctcagctctatggcaaatgttgggcaaatgaatgcaaatttatttgttttgagttaaaataacatgtttaggaaatgtaggtatatattttaaaaataattcatttaaccacagatcttgatagtttcaaataaaactatttctcatatttacataaatcattgagacagtctgaattattataacttaaacagtaaaagaagtaaatagattagaaatgtgtgaacaaatgaatgggtgtaatgagtaaatgtttctattctaaaattcaaactttggcagggtgtggtggttcacacctataatcccagcactttgggtggctgaggtgggcagatcacctgaggtcgggagttcgagaccaacctggccaacatggtgaaactccatctgtactaaaaatacaaaaagtagctgggtgtggtggtgcacacctgtaatcccagctactcgggaggctgaggaaggagaattgcttgaactcaggaggtggaggttgcagtgagctgaaattacgccactgcactctagcctgggcgacagagtgagactctgtctcaaaaaataaaaaaaagttactttcaaataagaattttaaattattattttctatagggacaatagaaaaaaatgccttgcttcttgcatggttgatcgaaatttgaatttcaaaaagaatttttttgagacattctaaaaaaaaataattttgcatgagttttcttaaagagtacctccaaaattgtacagcctaggctgaagttcactgttgcagtcacggcttattacaacttgaccacccggactcaagtgatcctcccacctcagcctcctgagtagctgggactacaggcatgtgccaccatacctgtttagtttattattttttgtaaagataaggtctcactatgttgtccaggctggtattgaactcctgggctcaaacaatccttctgcctcgatctcctaaaatgctggaataacaggcatgaaccatcgtgcccagcctagaaataattattttagctttttaactctttattggcaatgtgaaatttttaggattattgtcaaagtttggaaaacttctattgagttgcttttgcataagcactgtaagattgagaacatttttgctgtgttagtgacaattccacacctcttacagtatgaggtaggctaagatatgtgacctgaaacggtgggctctgaaaagcatgtggatgctcctagagtcacgcagctatgcctgctgaccgtagtgttgccacaatgcttcacggttgcaagaattcaggaagtcatgcttcacctgattcctttacaaaaaaaaaatcataacgtgtttatattgtttatagttggcttttttttccccctgagacagtgtctcgctctgttgcccaggctggagtgcagtggcacaatctcggctcactgcagcctctgcctcccgggttccagtgattctcctgcctcagcctcccgcgtagctgggattacaggcatatgccatcacgcccagctaatttttgtatttttagtagggatggggtttcgtcatgttgaccaggctggtcttgaactcctgaacccaggtgatctgcctgcctcagcctcccaaagtgctaggattacaggcgtgagccaccgcatcggcctatcgttggcttttggaagtggcttatgcaatagatggtcctgacgcttaagtttgactagattcacagttgacctagctggaagaaccaatcattcacagataggtgagggaaggaactgggtccagaggaataacatccaaagaaacttcatgttttcacagtgaaatattcgctcatgctgtgtgccaaactgtctaggattctgcactgctgttgatggccactgctgcactcccttctactctgtgtgctcaggtgtcattgtttattgatgttttcatctttatcataaccataagactaccttaagttacacagtgcttttgatttttgaggaatgtacacacacacacacacacacatacacacacacacacattatctcatcagtttttgcttttttgttacatccctatcaggcaagtggagtaagtagggttgactcgcccagggtcacctgtttcaactagaacattgtgataccacatattcagggtttgctccaggctgtatcaagttcttttctgtatcgtatttatgatattatgatatttgaacacgttcataagtctgctggcattttaggttagttaatgtgaaccgctgccacagacgacctctagtcatagtaatcacagtaaatgcttatttctcagtccaatatcttaaaggccaatgaaggtacttctgatgcgatggctctcacccttcctgaggggcccaagctgcttttgtctcatggtgcagccacctgaaatgcagtctccagtagaatgagaaggcatccaggagagggcatgcaggcatcaaccccgcgacacagatggctgctgtcacacgctgcggtagtggtcacatggctgtgcctacatgctgtgaagtagggaaacatattccctggcttggtaacaactttctgtacagggaagaagtaaggaaaaaatgtactttatttcaaaaatcagttatttcagtcaagtttttaaaaagacaaggccaaaagaagagacaaacttataaatagtttcttcttggctaccacaccaaaaccttacttttaagcttaaaccatgaagaaagatgctcaggatatgaaactaaaaagacattcagagggcagagtacctatatataattcttttatatttatattttccatatccatatcttgtgtgaatgcatttttgtttggaaacctgaaatataatttattatagatttctattctaatgtatattctgatttaacccccatatatttttagaagcatattattaaacattttgaattcattcaagagcattttttttgttttttcttgtgtgtttgttttgttttgttgcatgtggtatttcagaataccttatgggacatgaatccctttccagggagctgcagtttagtgggcagataaaccgcattcatgaagtcaaatgcagtgggaaaatgcaaatgcctgagagatgcatgtagagtacttgggaagtctgggcaggaggaagcgggaagggggttgaaagttgaaaaactttggtgatagcaagataggcttgtccgttcaatttttatgttttccttcatttaaagaaaaagttaataatccaagtgcatttttaactaccagaaaatagaaaacgatataaatgtttttgacagagtaaaaagctatttcttggcaaaacaaagttagtattagtttttcttttgtagaaatcattctcagtaaccaaaaccgtatggtactggtaccaaaacagagacatagaccaatggaacagaacagagacctcagaaataataccatacatctacagccatctgatctttgacaaacctgacaaaaagaagaaatggggaaaggattccctgtttaataaatggtgctgggaaaactggctagccatatgtagaaagctgaaactggatccgttccttacaccttatacaaaaattaattcaagatggattaaagacttaaatattagacctaaaaccataaaaaccctagaagaaaacctaagcaataccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaagttttccaatctacccatctgacaaagggctaatatccagaatctataaagaacttaaactaatttacaagaagaaatgaaacaaccccatcaaaaagtgggcaaaggatatgaacagacacttctcaaaagaagacatttatgcagccaacagacatatgaaaaaatgctcatcatcagtcatcagagaaatgcaaatcaaaaccgcaatgagataccatctcacaccagttagaatggctatcattaaaaagtcaggaaacagcaggtgctggagaggatgtagagaaatgggaacgcttttacactgttagtgggagtgtaaattagttcaaccattgtggaagacagtgtggcaattcctcaaggatctagaactagaaatatcatttgacccagtgatcccattactgggtatatacccagaggattataaatcatgctactataaagacacatgcacatgtattgtattctagcactattcacaatagcaaagacttggaaccaacccagatgtccatcaatgatagactgggttaagaaaatgtggcacatatacaccatggaatactatgcagccataaaaaatgatgagttcatgtcctttgtagggacatggatgaaattggaaatcatcattctcagtaaactatcgcaagaacaaagaaccaaacaccgcatgttctcactcataggtgggaattgaacaatgagaacacttggacacaggaaggggaacatcacacaccggggcctgttgtggggtggggggaggggggagggatagcattaggagatatacgtaatgtaaatgatgagttgatgggggcagcacaccaagatggcacatgcgtacatatgtaacaaacctgcacgttgtgcacacgtaccctagaacttaaagtataataatttttttaaaaaaagaaatctttctcatttgctcaccaaaaagatttagtggagatatatgtatctccactataatatatgcagcagatatatttctatttcctatatacatataataggaaatagaaaaatatgttgataagcacagaaattatgtattatgaagagtttcaagatagtttttactagttttataaattaccaatgccttctcactgtctaagaatttaaactccgtagaaatatttcttttttttttcttttttttttttgagatggagtctcactctgtcgtccaggctggagtgcagtggagcaatctcggttcacttcaagctccgcctcccgggttcacgccattctcctgcctcagcctcccgagcagctgggactacaggcgcccgccaccatacctggctaattttttgtatttttagtagagacgaggtttcaccgtgttagccaggatggtctccatctcctgacgtcgtgatcctcctgccttggcctcccaaagtgctgggattacaggcgtgagccactgtaaactccgtagaaatatttcaaacatttaaaaattcaaagtgacggcaattagcccggcagaaacaaatctgactgtgctttccttgtcccttgaaagtgtcattgaagctcctgtctaatgaagattgtggcatcagtgttcaggcttgtcacctgctcctcgtaagaacaaatagggatacttagagggaaacagtttgctacaggtagtgttctcccagagagacaaaacgcgaggggccgagttgtataatcaggtgtgctgaaactccacggggcactgcttaacaaggttgctttttgtttttgtttttcctcagtgtggttagcaaattaattgactggagaaaaatgcacatttagaaacaagctaatgtgcgcggcatgcaaagtcgagccttctgcacctgccagtctctcctccccgctgctgccgggaactccccgcgatcccagatcggcctgcgctgccttcctccttccctatccccgggacgccccgtcaccctcagcctcgcgtgcacggtgcactcccgccagggccgctcacgccctggtttctgtcccggctctactcccctcccgctcagtgattaaacaggtgatggctgagcacctgccagggcgccggcggtgtgcagggccccgggctccaggccttgctaagcgggctggcccgctcccggggctcggtggaatgaggggcaggactcggtggcccgcaccgccactgccagctccttgtttgcagacactcctctgcgagtctgacgattgtgcccttgcttaatcctcggacccgttctccgttctcctccgcagtaggaagcaggggtgccgccggccccatctgcccgtgcccgacacggacgaggccttcacgcagccctgaccctttccatttcccagggacttgcttctcgttggctcagccccagggccctggattcctctgtcctcgcgccggcccgcggccaggccgctccctttgctcgcagtgggtcttgtagcttgctgctcggctgggacggccaccttgcacctgtcggtgctgcagggcgctctccctgggcctgggacatcggtctctgcttcacttcacctcacgggtgggcccggaaggcttcgtcttcctacgcctcacctgaagctaggctgtgattttttaatgagctcttccatacatttatggagtccctgctataggctcagaatcgctctaggtgtcagagatgcagtggtgaaaaagaaacgagtcttatcatccagcctgtgtgtggacagaaaaggtttaaagccaggccctgttgtgcctcattgctccaggagacattttcctggctgagtcaaaaacagaagctgcctggattgcacctatcataggaataaaaactagcatttattctgtatttactatgaatcagactcttgtgactgttatatgtattaatttaatcttctaaaagtcccacaaggtggatacccatgccatcccattttacaggtgagagcactgaggttcagaggggtttaaggccacccaggtagtaggaagggccagattcagtgtttcctcttaagtagtcttcatagatcctttatgcctagtcaagtgcctttgaggacaaaagaagagagaagcagggagctgtgaagaatagagaggtggccagaacaatttcccttatgctgggaaggggaggtaggcttgtgagcagggaagacccacatgccacatgctggtggtgcctgggaagttgacaggaccccagaaagagggtatgcccagggagactgcaggctgtcagcttctcagcactggccaacactctcatacatcacgcgtggcacagaaatagagccctcagatgcaagggtcctcatgatcttgaaccatgcagttgtcagtggtgaacaatgaggcttaagaataatggtcctttcccatttatttaggtggtcacaactgggtcccagtatgatccttggagggggagagggccctataatgtttgtacttaaatgtcctgacattcccagggatggaggctcagaatgaggactgcgttctttaaaggaataaagaaatggccgtgtcttgcacctgcatttcctgtttgattcatagctacaacatggcaaatgtcaatgaatacagaccctgtgtcaaggggtgtgctatttccttgatgcattgtggtgaataaaaaagcctgacttgggccgggcgcggtggctcatgcctgtaatcccagcactttggaaggccgaggcgggcagatcatgaggtcaggagttcgagaccatcctggccaacacggtgaaaccctgtctctactaaaaatacaaaaatcagctgggtgtggtggcacgcacctgtaatcccagctacttgggaggctgaggaaagagaatcacttgagccagggaggcggaggttgcagtgagccaagattgcgccactgcactctagcctggcaagactctgtctcaaaataaataaataaataaataaataaaaaagcctgacttggctgggcatggtggctgacacctgtactcccagtactttgggaggctgaggtaggtggatcacctgaggtcaggagttcaagaccagctgaccaacatggtgaaaccctgtctctactaaaaaaaaaaaaaaaaaattagctgggtatggtagcgcatgcctgtaatcccagctactttggaggacaaggcaggagaatcacctgaacctgggaggtagaggttgcagtgagccgtgatcacgctattgcaatctagcctgggcaacaagagtgaaactctgtctcaaaaacaaaaaaacaaaaaacacctgacttaataaagtccacagttgaatgggcaaagccaatattaagtaaatacaaaatttaaatacaagttgtgcattataagaaaccaggatgctctgagaggagataatggggagatccaccatgactggggtcagggaaagtccgtcctgaaaacttcccacagaaagtggaggtgaggagctcaggaacacagggtggggaggagagattctgagcacagaggacagacagcacaagcaaagagtagaaaacagtcacagaactgaaaagacacctgggtacccaaggcatagtaagggaggggcacgtgggattcagctgaagatgtaagtcaatcgggtgggggtcagtcctgtccaacccatggcccgtgggccgcatgccacccaagatggctttgaatgcagcccgacacaaattcataaactttctgaaaacattatgagaattctttgcgatttttctttctttggctcatcagctatcgttactgttagtgtattttatgtgtggcccaaggaaattcctcttcttccattgtggcccagggaagccagaagattggacacctctcatgtaagtagcagccggaaactgaagaacctcatgtgtctcatcaagggcttgtagtttaatcttacctgaaattggaaaacattgagggctttacaaaatagagaaaacaattagatttactttatacaagatcatttgaatggagagaggaaatggcaagatcaattgagaagctattgttataggtgaggaaaaagttggaggtggcttacggtggagacaggcagcgcaaagagaacaggatgcaccagcaatggattttagaagcataactgataggactgggggaagtgtggtgtgtagggggcaatggagaaggtgatgtccgggagatccctagcgtgctggaggtgatgtctactgagatggagtagaaacagatttaggatcaagattaagaattcagatgtgcggctgggagagatggctcaagccactttgggaggctgacgcaggcggattatctgaggtcaagagttcgagaccagcctggctaacatggtgaaaccccgactctactaaaaatgcaaaaatcactggatgtggtgtcgtgcacctgtaatctcagctactggggagggtgaggcaggagaattgcttaaatctgggaggtggaggttgcggtgagcagagatcacaccactgtactccagcctgggtgacagagcaagactctgtctcaaaaaaaaaaaaaaagaaatcagatgtgtgagctccaagaagacatttaatcatactgaatatctggatacttatttgtcaatttaaaacccacacttaatttacagatagatagatacatctagatagatcttatatacacatagataggtcttttatagtagatcctatgtatattttatagtggatcttttatatgtatcgatatagatcatatatatctgttgctatttgtctaaagcaggagaaatctgaagactaagctcatatgtgctgattttatcttgaggtattgacataaacaaccggaatgaatgcaaataaagtccacaatgcttctggaatgttctataaaggcagatctacatctgcagaataatatgcttatgttagtcagcagagctttaattatttaattgtcttaccacactagcccaagaaagattttaagcctaagcctttaaaataaaaataatttacagatgctatagagagagaagtaaagtcgtccactattgatcctgtgtccttgatctgccttaccctcatgatcataaaatagaaagtacataaattaaggttttcaaataaatattcatggcatggtgatgtctaggcaaatttctttgagtagaaaagctacatgctggcttcctctaaaatactgagaggctatggtcacgagctggagggaggcagtcctcctgtaggtgatcagtgatttttttaatgctacagacttggacaccattttcattttggttgtaaggattttcatttttcctctgtgttttacatattttctcttgtttctacaccctagataccagactgaaagctgtgagcaaatgagaactctaaagttctacctttcactgtcacacaccatttctgtagcctaatcaaaatgcggcatctttttcctaaggcaatgccatatttttctctcatcatgacacttaatttaaaggtggcagactggaagatgcagtgtcctgtgacaaatttgtaagccgtgaattgatccctgccccacacacagcaatatccaagcatggtctctggcaacttaccataaatcatcttttacttctttgctcttagactttctgagagctgaatggcaatgcggagacagatgggggtcagctcttcactgtcatccatagctgctggtaatttacgggcgatatagaacacctgtgagttatggtgtcttttgtttgcctgagttgtcctttgctgaggactgcaatgcctacatcataatgtttgagtgtttactatcatatactacaaaaaaatacctaagtcatagaagcatggcattatacccatgagctttaaggtttatccaatcaaaaagccatttctctttgggcttgataccctgcgtctgatgtacaaggatgctggaggaatacgaatgccagtaagccacatagagctacagcaagctcttcatttcatggtcattaagagagctgagagggacttcattatagcaggtcttcgacagatgaaatggttctgcctgttccccggctctccacaaacaaccgcaggaggaactgtgcccacgttgttatgaaaatgcactttataaaaagtaaacataagcaccatattaagaggaatggaagaaataagtaccttgctgtttggaaaatctcaagtgcgagtttattcctattagatccttttaatttgtggaagaaagtacagtcttaattgcatgaacattattatcattaattaatattaatcaaccagatatactctcccaatttttcaagtattttctgcactctttataatcattgatgtttatcactggcctaagaagtgaaacacaaacctgcaacatcaattaagagatgatggattatggccaggcgccgtggctcacacctgtaatcccagcactttgggaggccaaggcgggcagatcatgaggtcaagagatggagaccatcttgaccaacatgatgaaaccctgtctctactaaaaacacaaaaattagctgggtgtggtggcgggtgcctgtaaccccagctactcgggaggctgaggtaggagaatcacttgaacctgggaagcagaggttgcagtgagccgagatcgtgccactgcactgcagcctggagacagagtgagactccgtctcgaaaaaaagaaaaagaaacaaagagatgatggatgatataatagtagaaggatcagttattatgagtggcaaacatgaaggagctgtgatgggccataagaaaatgttagcatttatttaacaccggtctaatgatccccacctggcaagcataggcaagtcttcattttcacttttaatttacctggcacatacattcacttatcatactgtgagataatcataggtttatacatctgtacttctattgatataagttctgaaataattaagaacattagagatggggtggtgatttttaaaaaaaattagcattcaaaactaattctagactagttctcatatattaggcattcaccttttaaacaaataaaggaacagataaataaatggaaatggaaaaaagaaatagggtaacagaaatacatagttcaggggccaaggtgtaggtctatgaatataaaatcagtgttttcacagtttcgtataatttaataaatttgaaatagaaaccacatagggtgctacatgaacttttaaaattaaatgtacagtctctgatttgcaatggtttgattgaggatttttcaactttgcaatggtgcttaagtgacaggcattgaatagaaaccatactgcgaccattctgtttttcactttcagtagggtcattagtaagttatatgagatattcagccctttatttacacaaaataggctttgtgtcagaggattttgcccaactgtaggccactgtaaatgctctgaccatatctaaggtgggctaggcatggttgtgatgttctgtatggtaggtgtattcgtgcactttccacttaggttattttcaacttaggatgggtttaatggggagcagggggtgcacacaactccattgtaagttgaggagaatctgtgttctgttttcaaaatccatatgttaaaaatgattgatgtcaaataggcttccaaaacatactctaaaataggcaaatccgctgaagtatggaaagagcacgacacagttttactgcacattcccctggaaacctttgtctgaaattttccaaatattcaaaataaggtattataagttctctggagagggatttatttttaggaaaaggctgtcattgcttgtggagtccatattcataagtggtttttgtatttggtattaattcctctatactataagacccagaaagacatgttctgtagggtaagtatactaactctgatacggtttctttcaacagattgttctcaataattaaaatggcaacaatgacaacagaaaaatcagatatgaatagactctatgtcttctagtctttatcacaataacctgatattttaatcctgttaagtactatattattccagagtatacaaagagaaacagtggcggtgtgtaggcgggatagattaggctggtataaactcttttcatataaatgtatgcattgacgtgcaggcattgtgatgcttcctaagtcaattcaattaaagtcataaaaacttcacaaagctgaccacacctgtcaaaaaaatgtcaacgctcatcagccttctatttcttctttttttttttttctagcctaattcaggccactccccattttaggaatttctagattgcaagacttaaacttaatgatttcactgaactttgcctattatagtacattttccttctttgtgtcagaaaggcatataattgtgagaaatgtgatttagaataagggagagcagtgatttttaataaaaaataacatgatcgattccacaaaatacaacaccatttcagagagcttgaaggtataataaaattctagagtgaataattatataacggcttatgagctttcacaaagcaaatggtaatcaggctaagataaattaactaagattaagaaataccagattattaactactttttaaaatagtctttttagacaggaagatttggaaaatgctatcaacatgtcatatatgaatttcaataaaaaatgtgacaaagacattctggggagtattttgggcaagctagtgacttgtagattgtatagtcacccacgtgaatttgtaattgactgaaggccttctttcacagatgctgctgctggttcatggctgtcctggacagacgcctgcagagtgtgctcaggcccatgtgttcagccctgccgtgctcactatttcatggactggtgatcgaaaaaagagatggagccactctaatgagataaaacaataggaactgtatagaaacagagctgggtagatggagtgtaagagtggtacatgtggccggggaggtggctcacgcctgtaatcccagcactttgggaggctgaggcaggtggatcacctgaggtcaggagttcaagactggcttggttaacatggtgaaaccctgtctctactaaaaatacaaaaattagccagacatggccaggtgcggtggctcatgcctgtaatcccagcactttgggaggccgggacgggtggatcacgaggtgaggagatcaagaccgtcctggctaacacagtgaaaccccgtctctacgaaaaatacaaaaaaaaaattagccaggcgtggtggcgggcgcctgtagtgccagctactcgggaggctgaggcaagagaatggcttgaatctgggaggcggagcttgcagtgagccgagattgcaccactgcacttcagcctgggcgacagagggagactctgtcaaaaaaaaaaaaaaaaaaaaaaaaaaaaaggaatggtacatgtgaaaaggacttatagcccccccgcttttattcttttgtaattttgtaatttatatttacagattgtccttttctttttttaaaaaaaacacttatttaaggataagcaatctgtttgcttgaactggcagtgttgtagaaaggttccagtaaagagcgttttcctccagtggagctgactttgtgctcagtctttacaccacgaaagtaagggtcatgtggttgtggtatctggggaaagagaaaaatgtcaaattcagacatagctccgtaacttgaacgtaacttcctcttttaaaaattatttttaatataacatagttttctgtaaaataaagtaaaaatattaataatagtggatttaatgtcgagcaggatacataatttacactatctacaatacttacccactgataaactccacacgattacaactgattcatgaaaatgaataaataaacaattcagctcagttgagttagaaacatttccaaaattaaatggaaggcaagtgttataagcaaacaaaaagtgttacatgaaagtgaggataaatcttttgcagtaaattattaatagatacccattttttattttgaagattgaaatactaccacattttaaatatagtaagttcaagcacaatttaatgaggaatagtcaataatattcaatataactataaaaccagtgatgtataataactggtacataaaattctaatacagagtgttaatttttttggtaaaatatagttaaacaacaatcatattaaatcagattggcattacctacagtgccaattctttcctgagttagaggttaaataaacatgtgattgagaatttcaagttgaatctaaggacaagaagttagtctcgcccagttgtgttgacacaatctggccagatgggctggctggaactggatttgacaaaaagtagtggggactgctccaaacctccgtgtatgcagcaaaaggttaaaaatgcgtttcaaacatttctgctgaataaagttagaaacgagcatactgtgtctcgaagtcgacatttccatgaagatgaaggaggcattgagtgcctgtccgcgtgcctccatggccagtgcattgaaaggaaagttacacctttgaagggagctggtggacctttggctgattatagaatacaatcatggcgactcacagagccacataaattaaaataggaactgcctggatggttgtttaaaacctccagaaaaatacctcaaaggcgagatgttaaatgcttgaatcagacatctcttgttataagtgaaatctctgttcctgctacattttagtaacattattgcaggaatttggttaagtgtggatgcaaaggacagttgtatcgttaaacagggctaactacagttgcaatattttagacaaaggatcacgtagaatcagaacctggatttttacatactgtggccttatctgcagtccatcttcgtgtttgcttgcttagctttcacagaagtaaactacatttctaataagggctcataaatttgatcataaatgtattttctttaagaacttcgagactttcattggcaattgattatttatttttcgctgatcttatggccacacttatttaggtgacattctttaacctgatttgtgaatttaaacttggcaattaaaaagcggaaaacaaaacacaactttgcattagattgggtgtagtgaagtctgtgggttagcccatatgtaactttacctttcacactgaatttatgtttctatttctgaataattcagtaaatctatataaattatgtaaatgaccaatacctgaaacacaagctaaacctacacaatagatagtcacacacacatatatacatctgaaatgtaatgaataattcaaaatttgaattgtaaaaagcattacagaataaatttcaatgacaagagatttgatcgacacagcaaaataggtcaccacagtcaaaagtttgcccccatttaatgctggtgcctgagccgtcctaactggtccgtgaaaacttcgacagaagaccatgcttctttttatttgctttgagcagtgcgtatatacctgtcttgtactttttacggacagtttcagttagaaccactttgatacaagaatactactgaacatttacatttttagcagaggtgctttcttttcttcaaccagcaacaggcatagctgctgcaatggttctctctccaaggtagctggagctggcgcttccaggagggtggggatcaaagctgcgaagagaaacctaaagaactggtctcaggctcttgcccatgtgaagcataaaagtagagagaggaggccgggtacggtggctcacacctgtaatcctagcactttgggaggccaaggtgggcagatctcctgaggtcaggagttctacagcagcccggtcaacatggtgaagccctgtctctactaaaaatacaaaaaaattagccaggcatggtggtgggttcctgtaatcccagctactctggaggctgagacaggagaattgcttgaacctgggaggcagaggttgcagtgagccgagatcatgccactgcactccagcctgggtgacagagtgagactccatctcaaaaaaagaaaaaaagaaaaaaattttaatcagatgccatgtacacggagaacagaagcttggagcaaagatttagaaggggctaatttatgtctattcagggtaggcacagaagttttttggtaaggtgcattacttctggcagagctgtatattgtaaagtagacagaggatgatgtgctgtgtgaagaataaggtttcccagtggtcatggtagaaaataatataacaagtaaatgaatgttatcttcaggttgaaggaaatttttcatatggctttttttttttttgagagagagagaagggagccttgttatctttcccatgcttcagcctcctgagtaattgggattacagtcaccagccaccgtgcccggctgaatgactttttaaaagctttccatttagatcaccatattatttatacagtgttgggatgttcaagtaaattatctctttgccttttcttttttttttttccaatgagataaacttaacaatgcagagcaggatttctttagtcttggtggcttaccctaaatcatattgcaaatgaggtgcatttagtttgtcttcagcatagcatgtttaccacctgagaatgataatgaagcagcaaatagttactatctactgagggtgcaatacactgactatgccatgtgttgagttcattcattcctcctgacccatggaggggtagaacatttcagtaacttagactgtaggattcgaggtctttaacattaaagtcattgctccaaactcctatattaataattgcaaattgcttattcacacaatgatttacaattattaatattctttgttcctttgcttttcccgcaaatacttatcaagcatcttttctatggcaggcactgttttttagggcacaaacattgcccaaagtctttccccttgttttgtgtatgttctaagggggaaacagacaatacaatatgtataatgaagaagcaaacaataataagacacaaggtcaaatactgttggtagtagcgcagctgtgaggcagatatacagtatagcggatatataatatagcagtttgctatattaaataggattatttaggaaggtgacatttgagcaaaggcttgaaagccacagacactcttcatgatgctagaacaagattgaaaacaaccccttccttcctgtcaacttacctatccccaggctgctatgggtattggaggacatgctaccattgccatactcctgggacgcagtgacaggataatagatgttgaagtggtggctctttacccaaacagagcatttacatttagagatctggggctagatatgtcaggcaatattccctatggtctgtctgactgtgcggtcctgctgttattggggtaggctagttccttggtgttcatgttgcatttgcctctcttccgaatgcagtatcagtgccttattcctctttatatacccatgtcaccacttccacaagcccagtatttatgccaatgcattgcagaaaagtactaagtaaatttttagatattgcaaaaatgttttttattttcaagatacatctttttacaaacataatacttttagtgaaaattactcacgaatggcaacaagaagaatcaaattgtactggcaaacataaaatgctttagtttaatcagacatttgctagtgttgtcttgttttctggtgccaagaagaaacccttaacatgcaagagaaagtgaaaaagtctaggggctgagaccatgtgaacaaacgtctttctgtcctctttatggtgaattaaactttgctcctctgacaggccaaatacaactaattccatattgggctgctttttcctatggtaaagcatgaaaaatctatccatgaatctatgtatagttataagttaattcaggcacattgttgccttagaatgatgaaatacatgcttacggaaagcaatctattggttgagactaggaaaatgctggctggagcccatgctgtctgttggaaacggagctgtggaaattgccagctctaaatgagataggaaatttgttgattggtttgttggatttctttttctccattattttccaaaagaagaagcaggcatgaattctggcaattttctatttttcccttgcttcccagatttagctcactgattgcataattttcttactgctcatttttcaggaaagtccataggcattagccactgccttttgatgccagtatgcatcagaaggcagtggctaacagggagtgtgtgtcatttccccgggggccaatcagctcaactcagtcacatggtaagtcagttgaaaggaggcagtgggaatcatagatatgggtgatatttttttttccttcccatggtgctcagagggcacaaaggaattctaaacaaccatcttattagttataaaaaatttttcacctctgcagaccttcacactacacttcaatgacactattaatttctcttaattgaacaggtgcaaacctttatcctgttttatattaataaacaggtttgaaacctctttgtttcaaatataccatttaaaaattagtgctaatgtttagttatgatggtctctgctgtaacacattcatgcatcaagcaattagtcatttcctagtgtgcacactgtattgttttaacctccaaagaagaatccagatttgctcccaaatctagaaacatggtcagatgcaccacttgatgatgaatacaaaatcttgacaattcaattttggtaaacagtaaagaatgtgtatatgccacacctatggaacatatcaagtaagctgacatcaaggagcacacagctaatatccgagcacttaacaataaacactttctagtgacatttctaggaaatcatacaaagtaggagcatgggtcaaaatgattagaaggcagccaggaaagtcttcacactggcatcataaattttattctttatatacatttctttttctagttgctaaaattaggaaagctggtagaagaagaatgggaaaattgaaggtaaataagtgatagagtgtttatttacaactgtgcctaagttcaaaaaaaaaaaaaagagagagagaattggttacctgtgaaactgttacctactcatctgggacagctgccctctggtttccttcagaactctacagaaaagactgacttagacaaatgcttgtttggaaaagatttttctttcacctggcagcttctttgcattgctactgcattaatctttttccatgcctgttttgttctcattttttgtttgtttgtttttgagacagaatcttgctctgtcacccagattgcagtgcagtggcgcggtctcagctcactgcaacctctgcctcccggattcaagtgattctcctgcctcagcctcccgagtagctgggattacaggtgcccgccaccatgaccagctaatttttgtgtttttagtagagacggggtttcaccctgttggccaagctggtcttgaactcctgacctcaggttatccacccaccccagcctcccaaaatgctgggattgcaggcatgagctactcagcccggcctcatgtggattctttggactccagattctcctccttcaatccagttttatatatgcaaccaccacacatagctttctcaggcagagttataatcacattcctattttgcttggaaaactttgcacaaatttgaaactagtacatgcacaaggtttataaagatgtaaaaacaaatatatagttagagtataattaaaggaagaatttatcaaatagcaactaagattaggtgatgtgaccatatgagtacttttaaaatgtcgtttgagttttcatatttatcaaattctctaacaaattggtattaatttagtaatttagtaatcagatacaaaatgttataaatatatttataacataatacttttttttctggctctttctcttattttgtacactaagtgcagtaagatgtacccgagggtttctttcaagtcttgggtctttaaaagatcaagcgacgcttgggagaggacagggaaaataaaatatggactgagtagtgtagatgctcagcctagcattcatgaggtttttaaagtttctgcatgattcattccagctcatgagctaaactgctacatgacacattagaactgaaggactcactggtgctgacgagtctgcctggagtgtccttagacatcgaagcggtgtcatggtgataggagaggctggtcagggaacccagactcttggccatttcttcttaagaaccattgctaacaagaagctttgatcagctgcagggaagcaactcattcctggggaaagggcatgaaaagaaccaggaaccatttgagagcacaacttaacagactgacacttaagaaaagggttggaatctttttttttttttttctttgagacagagtctcactctgtcaccgagcctggagtgcagtggggcgatctcggctcactgcaagctccgcctccaggtttcaagccattctcctgcctcagcctcccgagtagctgggactacaggctcctgctaccacgcccggctaattttttgtatttttagtagagatggggtttccccatgttggttaggctggtctccagctcctgactttgggtgatctgcctgccttggcctcccaaagtgctgggattacaggtgtgagccaccgtgcccggcccggctgctgccactttgcacccttatctctttcacacttccattgagaagcgtggctatgagcctgtgattggaccttctctgagaatccagcgagtgggcactggagaggaggaggtgggggactggacaccccactgcaacacttccccagctcctgaagtgggttgctgtgtccatttggagagttagagagagatctttcccaatagcccttctctaccatctaatgcctttctgtgaagagatgggaatctattttaaaaacttggtccgtttcttcctcttcagatcttctgagttgacgttcccactttgtgagtttactgaaagcaaaaaacaaaaaacaaaacccaaacaaaaacctatcacaatcagcttttactcaaaggtagtttggggagtagttagtcaaaggatggagagttggacaaaaatcgtcctatgtcccaggcacttagggggagactgcaggtctttctctaggcagtcacacatcacagctttctgggcaatctgggtctggcttcttacttctgcagtgcagatatagcagagggtcctgtgctatgtgttgtgatcactacatactgtgatcccagtatccccaaatgggattactcgactgctaggcaaatagcactgggtcctttaatgatggggtgttgacacacgtagtgtgatgaatccctcattgctaaccttccaagaggaggtattgcagtcccctgctggctggatttcaagtgttggaaaagcctaggattgactgcggcaattgcagcgctgggtagagttcagtgggtggaagccgggaagataccacatcgttaaaggcatattcatcatcttaagagcaggcagccccggggaagagtgtatttcagtttttgatagtttgtcaaggcacagtacagttcctttgtttgataatcagttcattttcctaattcaaaaggccaataccaggacgaaagacatctgagatggaaagtagaacttggtttcagcgtgtatgtgtgttaagtgcatgagaaaacctgtaagctacatgtcactcggagtcttcttttaaccttaacattcactctgtttcatattgtctgtaaagttcaatgccctcttcaataattctgcaaatctgtggataagagtgtgtgtgtgtgtgtgtgtgtgtgtgtgtgtgtgtgtgtgtgtgtggaggggatccatatgattaatttctgggccctcattctggtctctgttacgttctttgctgttattcctttatctctactctagcatttatgtgtatgtttaactcactccattccttgatttttccaccaaaaacaaaaccaaaccaaataaccagagtcctttgtttaatataactatgccttttttttgatctcgtgagatagaggaggatttttatcactgggatgtgaacgactgttctaaggagggaagctgtccagtccttcagagtgccctgttgtcctctgccgctcccatttttctcctgtgtgtgccctgttccctctgcttcctcagattctcctcctcagttactatcaatttgtagaacagcaggctcaattattttattcgcttcctgctaccgtatttgcagagtatcacctttcaccccaaacagcttattaagataatttccacaaaggatagcaggattcccagtgccagcttttaagataattactcaacaatcctgacacctgatttttttacaggcttgacgacattgtaatgaagtccattctacttagaatttcagtaacaaaatcttctggaactgccttccccgattacagttcctgtttatcccccaaacacccaatttgcccccatccctcctccttcttccctgcttagtggtagagcatgcccacacctcccttcctctttggaacggatgagacacggccagccctggttttccttcaatcagcagtgtggaagcagatcatcctagctcttaaaggctctctccctggccagcagacatatctcaaactgactgaacgctcttcttccagaatgtgctaaggactgtctgacattcttccttaaggctgaaccattattcatttttgagagtcctggaatttggaagataaactccctcctactctagcttttgggactcctttctatttggccactcagtagtataactgtacaaaagaaataaacagctaaagttgagtggctttttctgagtcacttcacaggttcaataaagatgcatcattccatgtcttcctccatttgggctgctgtaacaaaatatcatagatggatggcttataaacaacagacatttatttatcacaattccaaaggctagaagtcccacatcaaggcactggcagacttcatgtctggtgagggcccatttcctggttcatagacagtgtcttcttgctgtgtcctcacatggcagaagaattgaggggatctctggggtctcctttagaagggcactaatcccattgaggggccccacccttgtgacctcatgtaacccaaattacctcccaaaggcctcacctctatcaaaatgggggttagattttttttttttttttgagacgaagtctcactgtctcctagtctggagtgcagtaatgcaatctcagctcactataacctccacctcctgggttcaagcaattctcgtgtctcagccccctgagtagctgggattacaggcacgtgccaccacacttggctgatttttgtatgtgtgtgtatttttagtagagatggggattcaccatgttgcccaggctggtctcaaactcctgacctcatgatctgcccacctcagcctcccaaagtgctgggattacaggcatgagccaccgcgcccaggcgggggttagattttaacacagtcagtctacagcatgcggttttcttttcttttttgtggggggacagagtctcgctctgttgcccaggctggagtgcagtggcacgatctcggctcattgcaacctccgcctcccgggttcacaccattctcctgcctcatcctcccaagtatctggctctacaggcgcccgccaccacgcccggctaatttttttgcatttttagtagagatggggtttcaccgtgttagccaggatgatctcaatctcctgacctcatgatccgcctgcctcagcctcccaaagtgctgggattataggcgtgagccaccgtgcccagcccatgcctttttcttattcattgtgaagactgaaaacagacgaataacttgctttatgtcagtatctttatttccctgtcagtgtattcaatgacacagaaaatacttgattccataaatgctcccacagaaaaacacttcatgcaaaccttcctctccatgtcttctgtccattggagaacccaaactaaagaatgtctcacacgtagttctgcacattccttcccattagcctagttgtttcagatgaaaatttagaagacagtgtaggaggcgggagaagccaagaaggaaggaatctgcatttgaagaagggtcatatgcataatcacgaatagctatttggatttgataaagaactgctattgtgtttggatatacagaaaataaatgtttggaaatatagaatatacacacccaaacatatatacacacacatgttggacacatattggactttgttacaacagctacctatacctttactgatacagatctcactacttgccaggcacctggttctaggcccattaagaactgtctcagtgacctcagtggggcccctcatcaatggctgccatctaggttgagcactctcggctgagttcccagtttctgtcattcacggtccttcctcttcagggatgcagccaccttgcagaatgctataggggcgtcaggcactggccttgacatcgaagcctctgtcttcttgctctccatctctttgagttggaccactctcttctgcttaggaagtaccaggctctctgctccctctttttcccaaaccaaaccaaaccaatgtgtttttactgccgatggataggcctgccacttagaacagaaacataccttagcttcagatcctgttgtcatatgagtttgtaggttctaattgaatataaaaattcaaatttcttttacataaagtatctctctctctcttttttttttttttgatggagtctagccctgtcgccaaggctggagtgcagtggtgtgatctcggctcactgcaatctctgcctcgtgggttcaagcgattctcctgcctcagcctcctgagtagctgggactacaggtgcgaccctttacacctggctaatttttgtatttttagtagagacggggtttcaccatgttgcccaggctggtctcaaactcctgacctcaggtgatccaaccaccttggccttccaaagtgctgggattacaggtgtgagccaccgcactgggcctatctcatgtttttttgttttcagctaattattattactttagaatcactgtgtgagctagatgagagacatcttcatattttaagcaattgcagtttctggcttagcgcctccattcattcagcaaacagctttttagccctggtttgtgccaggtgctgctccaagtgctaaggatatggcatggcacaaggtgcatgtgacccccagtcttgcagcgttgatgtttagcattataatacaataattggctgaacttgaggttttaagagatgagggtgatgttaagagatttatcttttcactgtttccagttcctattgtagcagtaggaacaagaaaagtatgaatatctcaacagttaatcctgttatatgtagctataaggacattgctacaattaatagatagcttagaaatagcaggagaaaggacgggcatggtggctcccgcctgtaatcccccagcactttgggaggctgaggccggaggatcacgaggtcaggagatcaagaccatcctggataacacattgaaaccctgtctctaataaaaatacaaaaaatagccgggcatggtggcgggcacctgtaggcccagctactcgggaggctgaggcaggagaatggcgtgaacctgggaggtgaagcttgcagtgagccgagatcgtgccactgcactccaacctgggagatggagcgagactccatctcaaaaagaaaaaaaaaaccaccaccacaacaaaaaacaacaaaaaacaaaacaaacaaaatacaaaaattagccgggtgtggtggcggacacctgtagtcccagatacttgggaggctgaggcaggagaatagcttgaacctgggaggcagaggttgcagtgagctgagatcgcaccactgcactccagcctggtgacagagcaacactctatctcaaaaaaaaaaagaaaagaaagaaaagaaatagctggagaaagcagaactgatgtgagaaacaatagattctagaaactaaatctaaatttgcaataattgctgcaatttattgagcaagtacatattagatggctaagtttatatacactctcatcataacagcagctctaaaaaactggaattattatgctcattttacacatgataaaactaaggtgtagaaaggttaagtggcttgcccaagggtacatagctaatagaaggacatttaaaatcaaggttttttttttctttttctttttaaattttattttagattcaggagtgcatgagcagatttgttacaagggtatattgtgtgatgttgaggtttgggctgctattgatcaagtcacccaaatagtaaacatagttcctgatagaaagtgctgtagcctttgttctcttcccttcctctctctcctcttttggtgttgccagtgtctaccgtttccatctttttcatctttttttttttttttgagacagagtcttactctgtcactcaggctagagtgcagtggcgcgatctcggctcactgcaacctctgcctcccgggttcaggcaattccctgcctcagcctcctgagtagctgggactacaggcacctgtcaccacgcctggctaatttttgtatttttagtaaagacggggtttcactatgttagccaggctggtcttgaactcctgacctcgtgatccacccgtgttggcctcccaaaatgctgggattacaggcatgagccaccgtgcctggcctactgtttccatctttatggatgtgtatacccaaggtttagccccacctataagtaagaacgtaagatatttggtaaaattcaagttctacatgcatgttcttttctaaacattgctaccctgaagaataaactgagaacttttatcagaattgagtctaagctgacacacaacatatcactagagaggtcctctcacgtttccatgataccattttcctaccatcatggtgggcctgatggacattgacttataagccagagagtccttccagtttggattgcacattatttttctagctcagagaccggcaaattacggctgcaggccaaatccaaccctctgcttatttgtatattgcctctgaactaagaacatttttaaatggttgaaaaaaatttcaaaagagtaagtttttttttttttgagatggagtctcgatctgttgcccaggctggagtgcagtggcgcgatctcggctcaccgcaatctccgcctctcaggttcaagagatttccggctaatttttgtatttttagtagagacaaggtttcaccatgttggccaggctggtctttaactcctgacttcaagtgatccacccgcgttggtctcacaatgtactattattacaggcatgagccactgcgcccggcccaagttaggtaatttttgattcggctttataggcaggaaaatgagactcagagaattataatgccctgctcaaagacacacaaagtagtaagtggtagaaaaggaggtttaagactagatctgtttttatagaaataaatacaaagcaaaaccaaatcactttgtaccgtaatatgtcatagttcatgaacaaaaggcactgtgtgcagaagccttatgtgcagaactccattccaaatagataatcttttttccttcctctattgttagaatcaggaagattttttgtaatttaagatactgtgtttctccctataacccactccattggcagcactgtggctaaccctgtttctcatggctccttctacctttaacaaaatttaaaacaggtaattgtgctgttaattggggcttgggggatgttacccttccttcctctggaagggttcaatgttcaaaggcatctagtcattatttagtggtgaggtaatgtctctagaatttggaagtgaagctcaaacagaaagaaacagcaggactggacgggcttccaaagagtgacttattttaaagagaccgattcatcttttactaattggagatacctagttccaattaatttaaggtagtgcctcatcaaaatatgaccaaagtaaaaagaatattttgcaactccatcaagttcattgtaaactttcttaagaaaaaaaagttttggccgggcacggtggctcaagcctgtaatcccagcactttgggaggccgaggagggtggatcacgaggtcaggagatcgagaccatcttggctaacacggtgaaaccccgtctctaccaaaaatacaaaaatttagccgggtgtggtggcgggcgcctgtagtcccagctactcgggaggctgaggcaggagaatggcgtgaacccgggaggcggagcttgcagtgagccgagatcgcgcccctgcactccggcctgggcaacagagagactccgtctcaaaaaaaaaaaaaaaagaaaagaaaaaaagaaaagaaaagaaaagaaaagaaaggaaaaaaaaagttttaatctaatgccatgtacacggagaacggaagcttaaagcaaagatttagaaggggctaatttgtatctattcagggtaggcacagaagttttttggtaaggtgcattacttttggcagagctgtatattttcttttgtgggagaagggagaagttttttttttcttttctaattcaaatttcaccatggcatgagctcaatattcttcaagacaaaagaatcttgaggtcttgcttctcactgcatagaaagccaatcacagagatgatgtgtactgccagggaagaaggcattttgggtgttgcagctgaaaagatggtagatcagttttaaatccacctccctagctgactaaaatgaggggtttatatagcagggaagaaatggaaaacaggaattcgggtggggtaaggaagaggagttggttgacaggcagcaggtgatcagttagacaatcgtgatgggtgaggggtctggcatctcatcgtccagaggctgtgatgtggtgagtttcagcttctttgaccaggaggcctgatggttggtttcctgttaaaggaactcaggtaagacaaatgtacctttttcaagtttcaagactgggagggaaaatttctacattgtattagtcagggttccctagagtgacagacagacacggttctctaagttcatatatatatgaacttatatatataggagtttattaagtattaactcatatggtcacagtgtcccacaataggccctctgcaggctgaggaacaaggagagccagtccaggttccaaaactgaagaactcagagtccgatgtttgagggcaggaagcgtccagtatgggagaaagatgtaggctgggaggctaggcccgtctctcttttcacattttctgcctgcttatattctagcaaccctggtagctgattagatgatgcccaggcagtttaagggtgggtccaccttccccagcccactgacttcagatgtcaatctcctttggcaacaccctcacagacacaaccaggatcaatactttgtatccttcgatccaatcaagttgacactcagtattaaccatcacatatgtttacacaaaagtaaccataaacttcaattatatgggacaactgggtcagtttcatttctaccttcgttttctcagagcccatgttgattaatgaatattttgaagatgaattccatttctacagtacactgagtacaatggagagtagaagaaatcagtattcaagtagctgcaaattgatgactttgcattccggtttaactctagcagttgactagagtagcctgtcttaatgagtttattcaatgctatgttccctgagaacatgtttgctgtttgggtagtccctgatctgcagggaatcagctcacaaaggagtggccaacaagtgaggtgggagggtgcggtcagggttgactgtgaggttccctccgtggcaactttgcagcctcgacaatactttttttttctttttttaataacgttttgcttttttggttcacatacttctttcgtgttgccatgtttaaacattgacaacactgctgaccaatttatttaacaggtccatattctaaattcattgaggaacatgacaaaaatgtggatcctactaattagtattttgttccaccactgataaaatatttagcagatacactaatctaatctccgttcttaatgttggctttagaggaaacaaaatcatgtcttaataataaagagaaagctggatggaaagtaagaataatcagcttgcattctgcatttccctttgaagtgaaaccagagaggtagaagagtttcagttgcgttgcttacatcaatagatcaaccatttaaacagaagcgtaactaaccgcaaatgcttaaagatttggcgtcattccaaagttgagtttttgttgttgttgttgttttttgtttgtttgtttttttcttgagacagaatctcgctctattgcccaggctggagtgcaatggtgggatctatgctcactgcaacctccgcctcccaggttcaagtgattctcctgcctcagcctcctgagtagctgagattacaggtacctgccaccacgccaggctaattttttttttttgtatttttagtagagacaggttttcgccttgttggccaggcttgtctcaaactcctgacctcaagtgatccacccgccttggcctcccacagtgctgggattacagtcgtgagccaccgcgcccggccagttgagttctttagatcattgtattttgaaccattcatataaacttgtttttaatgagagatgacctccttgatcttcctacagcctcacaggatgggactacagtctacattgagaggctcacctcaggaagatctagctactggtagaggtcatcagtcttgttaataagctgactattggcctctctttggtgtgacatcctggcacccttgatatctacagaaagaaatcagtgctggcattcaatgtaaatctccaaaggggcttaattggactttttcaggttaagataaaatgttcaatttttagcttaaagatgattctgggaccataaacatgccagatttgagttcagttaaggtaattatgtgggcaaaaataaaagtgcaattaggttgttctagccttaactaagtgcaattatcaagaacactaacctggagaaaataggttcattctttacattttactaagcttcccaggtttgctgtttctattttcacctgtcagtgggggtagaactatccaagacacttccaaacactaattccagatagtctttcttttacaaaaaacagtgttaaaaagtttttaaaaagaaagtaaaggaagatagctttcttaggtattctgtctcttttttgtaaacaatgaaaaaaatgagagaatttttgggtgtattttgagtactattcgttgaattgataatgtagtcagaatgtagaaaagaaaacatgaattataatttaaaagtttgactgttttggtcaggctgattgtttctagttaattactgataaatcagttgctttctcacacaacaaattctatctaatcattaaaacatccctagtgtctggaacacaagatgattcgtctgatcactttggttcttataatgaacacatgaagttgagtttatggcaagctctggactgtggcagcgactggcaagattaaaacaggagcctggcaattttcgtttacaaaatacaaaataatatccatttcagaattgtcagtttagcaaggtttctagtttaataaaatgaaaatatttattggcaaaaatatttggatttgttaaaaatctgagaattgtctaatctttcatggcaggtgatcaatgcatggaagaggatagagctcttcatcctagttcttctccaggttccaacctgagtctttgttcatgtgtaaacatgctatacaccaactcagcccactataaatatgctatatcatgaactgtttcatcaaggagttcctttaatccaacaatttcaaggactctttaaaaaaatttttttttttttgaaatggagtctcactctcttgcccaggctggagtgcaggggcgcgatctctgttcactgcaagctccgcctcccgggttcacttcattctcctgcctcagcctcccaagtagctgagactacaggcacctgcaaccacgcccagctaattttttgtatttttagtagagatggggtttcactgtgttagccaggatggtttcaatctcctgaccttgtgatcctcccgcctcggactcccaaagtgctgggattacaggtgtgagccaccgagcctggccttaaaaaaaactttttttttaagagatggggtcttgctatattgcccaggctggtctccaactcctgttcgaagccatcctccttctttggcctctcaaaatgttgggattatacacatgagtcaacatgcctggccccagggagcctttttaaaagaataaatatgtatgtgtatattttcttcaaatattaaatttggaaacaaatgtatcatacttttttccagtggagtttatttgcctaaatataggaagtaagactaagaagctaaactgttacttctagactgcattcaggaaatttgtttttccccaaaatttttattcattttactattttttggatgttatgaaattttttttctactgaatcggcggaatcaactggatttactaagttaaaaaaacagtaattttcaattagccatacactgtatatctaatttcatgttattgttgtatttaattcatgcaaccttcttagaaggtaaatgtcactgcagttttcattttgcagagaaaaaaatgaaagttagtgaacttgcctaatgctgggcaactatgaagtggctgaagccgtgtgtctttatttctaagttaatagcagaatatgtatagttaatggtttgagcactggtgttagacacatttggaattgaattctgtttccatcatttacttctctagatacttaattttacttttctgaattagaaagatacttaaatttacttttctaactcttggtgtgttcatctctaaaagatatagtaataatattgcctcctaggatacattcacgaggtttcaatgggataatgcaaacaatgcttttagtgctgtgcctggaaatttttagattttaaattttcaaaaagtatttatattattacaggcataaagtaagccaaaatttagcccaggggaggtacttgacgttttaaattagtttttgtattcttagcctggatacatgtatgtaaacccaagtttgattgtttgtttaataaaaaataaataaagaaagaaattcttaagactcctggaatcttgagcttcaaggctggaagtgttttccaagagcaaaaggttgatcagttacttcacgtcctggcttcttaaatattactaacatttcaacaccagaatgagaaggagaaagtgagggaaggaaggagtgaggcagagtgtagagtatgctggtgatagtatgcccagagagataacatttgcaatgggactttacaaacctcagctttacacagttagcctttgtgtaggatacattctaaggagaaatcctatgagatgtttcagattaaactgtagattccaaaataaaaacaattgggccgggcgcagtggctcacgcctgtaatcccagcactttgggaggccgggacaggcggatcacctgaggccagtagtttgagaccagtctggccaacatggtgaaaaaaaaaagattgtgtctgttgaaggaactcaataaatgcttcctaaacggtgtcacatgaacagttttaatttctcactcattaagagcaggactgtcctggggtctgaggtgaggctgagcttattaaaggggacaaagtcattacctattatggaggagataactctaaggacagggtacgaaaagccatagagtcccagttttcatgaatgcactcaaaaacctgaaaaattatgaaagacagggagaaagtcattcaaatacctctgagcaaggaagagtcaactccacactgaaacccgcgatggctgtcacatttcatggtgaagtacgaagcgggtaactgcctagacagagtgaggccagttggtcctccaggtgaggggcctgagtgccaaggaaacccttgcttctgacaatatccaagtgtttcctggttcctccatggttggcattttcaggcagaagtgcctgtggaaagttaatgtgtctacttagttactcagttttcttctcttttttcttttctttctttctttcttttttttttttttttttttttttttttttgagacagagtcttgctctgtcccccaggctggagtgcagttgtgtgatctcagctcactgcactctcaacctgccaggctcaagcaattctcccacctcagcctcctgagtagctgggactgcaggtgcactccaccatgccaggctaacttttctattttttgtggagacggagttttgccatgttgcccagactaatctagacctcctggacgtggtggcacatgcctgtagtcccagctacttgggagactgaggcaggagaatcacttgtacctgggaggcagaggttgcagtgagctgagatcgcgccactgcactccggcctggtgacagagcaagactccgtctcagaaaaaaaaaaaaaaaaaagattgtgtctgttgaaggaacttaagtgatcctattgccttggcctcccaaagtgtgggattacaggcgtgagccacagtgcccggcctagttactcggttttctaggagaagtgtcttagggactgatgtggcttcgacctgttgcttagaaaaggacaagcctgtcagaaatacatatccctgtggaagaaattagaacatattagaaacaaaacctctgccaaatatgcaaactttgcttcaatacttcatttgatttgaacaatggaagtgaaacttaccttggacaaaatcaagggaactttacacccttgtcttccctcttttcacgtactttcccctctgcatttggtggggaaagtcattcgcctggacgaactcttcagaccttcagatttacgtctttaacacctgcctatcaactgcatgattttctgtctttttctgacctggaaaagaaaaaaaagattttcttctccagaccacatggcaaagtctttctgattatccgttggtccttaatataacatgaaggcaactgtcaatttttttttttatactttaagttctgggatacatgtgcataacatgcatgcttgttacataggtatacatgtgccatggtgtttgctacacccatcagcccgtcatctacattaggtatttctcctaatgttctccctcccttttccctccaccgcctgacaggccctggtgtgtgatgttcccctctctgggcccatatgtctctctgttcaactcccacttgtgagtgagaatgtgtggtgtttggttttcggttcctgtgttagtgtgctgagaatgatggtttccagcttcatccatgtccctgcaaagaacatgaactcattcttttttatggctgcgtagtattccatggtgtatatgtgccacattttcttaatccagtctgtcattgatgggcatttgggttggttccaagtctttgctattgtgaacagtgctgcagtaaacatacgtgtgcatgtgtctttatagtagaatgatttataatcctttgggtatatacccagtgatgggattgctgggtcaaacggtatttcttgttctagatccttgaggaatcaccacactgttttccacaatgaccgaactaatttacactcccaccaacagtgtgaaagcattcctatttctccacaacctcttcagcatctgttatttcctgactttttgttgttgttgttgtttttgagacggagtcttcctctgtcgcccaggcttgagtacaatggttcgatcttggctcactgcaacctctgcctcccagttcaagcgattctcctgcctcagcctcccgagtagcgggaattacaggcacttaccatcacggctggctaatttttgtatttttagtagagatggggtttcaccatgttggccaggctgatctcgaactcctgacctcttgatccgcccacctgagcctcccaaagtgttgggattacaggtgtgagccaccgctccctgcctgtttcctgactttttaatgatcaccattctaactggcgtgagatggtatctcattgtggttttgatttgcatttctctaatgaccagagatgatgagctttttttcatatgtttgttggctgcataaatgtcttcctttgaaaagtgtctattcatatcctttgcccactttttgatgtttttttgttgttgttttctaaatttgtttcagttccctgtagattctgggtattagcccattgtcagatggatagattgcaaaaattttctcccattctgtacgttgcctgttcactctgatgatagtttcttttgctgtgcagaagctctttagtttaattagatcccatttgtctattttggcttttgttgcaattgcttttggtgttttagtcatgaagtctttgcccatgcctatgtcctgaatggtattgcctaggttttattctaggatttttatgatttttagatcctatatttaagtctttaatctgcagcaattgtcagttttatttattcactgcttatctgtattttctaaagttgcaaggaaaaaaatagtatttatttttaaacttttgttaaaattatttatttatttatgtgggccaatagagtttattaacctattgatctctgaggaaaaaatggatatagtgatttgattatatggttatttgaaatctttactgaagaaaagtcacaaattcttctatttgaagttaaatatgaagcttctacaagtgactggacaaccttgtttatttgtacctgtttagtactttccacaagtaacattttatctgtaatgctaccaagattttttaaaataaataacaactctattttgaaggaatctaaaatttacatggagaagcaagaacttttctataatattttgtgatatcgaatttaatttcaggaaggtaatccatttgcaattcatactcaagaacaggacagaccagaagcatatagtacagctcaattgtaattttccaaatgttaatttcatgttgtttcttcctttgatttttattctctttaaaatatttttcattataattctcaattcaatagatgcctacttatgcagcgctaacatattttcaactttcatttacacattctacagatatgcattaaacacctactgtatgcgaatcactgggtgaagaactgccaagcagtgaaccagcctggcaggtttgtctgctctcgggcagccttcgttctaccaattgagcattggataagaaactgtgatgctctgaggtacaaagaggactcaggtgtccctaatccagtcttcaggacaggcaccctaaaggaaatggccttcacactgggaaaatggagcatgagcaagagatagcaaagccagcaggggtggggttggagaagacatctcagacagaacagcacaggcagagaacagtctacagccttacaggacacattagtttcaagcctttaacttggggaaaaacagatgctattgaaagttttcatcatgggagtgacacgcagggctgctgcatgttaccacacacattacaacatgcatgttacaacaccttattgtacacaggatggtacctgggatgcatgaagaagagtacctcatttaagtgagtgctactcacattgtggacatctgatatttatatatttattagagtggttttctggtagatggagataaaatggcttgttctaacaaaataagtatcttctgacaattttttgacagatggaagtaaattgtcttgaggaaagggccttttaaaaatttatacaaaggcagtggatccggctagcagcagactctggctgtaaccgtttgcattttaaaatacccctctcatgaacatttggagagtaaatcaggagaaggaggtggctgtgggatgccatttaggaggctcttgtgttgtctgtgtgaggcatgatggtggtttggactaggatggtgacataaggtgaaagacaagtagacgtgagagatatttagtgaggaaaatcaacaggccttgacagttgaacagatgtaggttagagattcctagatttctggctcttaatttatcaatttcacttgtgattttaatagaaattaatcatctagctctcagatgtctagctactctcctgacaagccaagggactcccttaacaagacctgatttctttattcaaggttgaaatgcatctcttggtattctgcttcagtcagctttggccttttttggctgccgaaacaatcgaaaactgttatgcagttggtgtctgttataatcctcagtttgcattggactgtcctattttttcatttctccagctgctgaatagctgaattccttatgattacatcctccccctctctagtgctctctagaagcttaagctcaggattttccatggaaattcatttagttatttcctcttcattatcatacactcttcaattcaactcttttgaatttttcttctgttctctgatgagtttatgctttctaacttggtcatggctgaaaatatcattaacctgctgctgttttctgtatttgtcattaataacaacgttggaaatttggtttgactcccaccctgaggagctaggcagtgggcatgcacacgcgcacacacacacacacacacacactcacacacacacacacacactcactccagctcaaatgctttgcaattggaaacaccattcctcttcaggcctttgtaagaattattatgagtgttgatagcaattcaattctgattaagtttattaaaaagtaaccaacatctcatgtacattcaaaagtgttccctcttccattaattatataattgagcaaaaagttattttatctaaaatgtttaaagcctggccactttactatgcttctttttcgataacttaaacataccaatttctctatataataatttttaatcatttgactttgaggattctactttaatggaaaataggaaaaatggatgtcataatacattctcagtagggacttatcagcaaacagaaacaatctacaaatttcatggaggagtttgatggtggttacatttgccacaagacatggtggtttccgatgcccagatgatgacctgccctcgaccactgcagatttagtgtgttctttgctccattagcagcagggactatgggaaagacatttcaataagattagaaaacaaaaaaacagggtggggcctttggttaacacatggttaacagactattcaaggagaagataacagcataactgaagtatttcaggtaatcgggattttaactgcactcaactcaccatggtgaactcgcccttagaaaacacttttcagctatgggtgatgacgacttttcaattttcttcctcttattttccttgatgtctaccttctgtgcatatggtcattaaggaatgccaaaaggtgatgtaagaaaagtagaagaaaatgacattattgtatggcattctctacaaagaaatatgggcagtggaggaataattgtctcatataactttgggattatatgtaaatttctattactaattgctgtctaactttcatttatataaatttctgcatctactgtattttaactacacaaattaatatactttcaaaagattactgagttctgtttctcctttcaacattcaagatgttgggtttttgtacagtggggtcctctgcaatattggcttgcaagaaaaagtgaccacgttagagcattcctaacagtgcatggagaaatgacacaaggcaatatgctagcgcacaaacattgtcagtgtttccaactctagtcaggtactataaggtagacagctcaattgaagactatgatgggggtttgtgctatcagatgtcagaaagatattcttgtaggaagaaaagaacaaacttttttaaagtagcatctctcaatattattctgagtaaatggttccaagaaagcagaaacaagtttattacataggagcttcaggactaaatggaaatccaggctcagggcttgcaggaagagggttagaagccagaggctcagaacccagttgagaaggtggagcaggaggagcaaaaggaagtcatcaagtgaaaagacacagtgggagtcagaaaataccaaaaccaatagccaggtctttgggagcttcaagagcagtgatatacacataatcaaagactaggtcttaagagtcacaaccactgaaggatatttaagaaagagattttaaaaggttcctcaggaaacgttgttgagtgcctgtggtggggttccactaatgagcttcaagtgtgcatcacacacacacacacattatttttcctaaaaaaggtatcgtagctttcattagattttcaaaggggttaccaacatctcaaagaactaaacccacagtgttgtaaaggccttcttagaagctaaggatacgtatgaatggtatgttgtaaaggtcctcctggaagctaaggatatgtatgaatggtcattaaattatgatatctgggagcaaatacgtgtaccaaaggaagactgacaatcccacattgatgaagaccatcaccagcctccatgtgttggaaatttaactgccaaacaaatgtgtaacactgatgtttctgtatgtgatgaaaatgtctattctgctcacagttaatctctacttctggacactcctgctttctatagaaggtgattagattagaaaaaaagtatctgaatgttgaaagagaaactgggtatcataaaattaattattgaatgttgccaatatcacaaaaatacaaaagataattcaaggctactatgaacacctttatgtgcataaactaggaaacctaaaggagatggataaattcctggaaatacacaaccctcctagattaaccaggaagaaacagaaactctgaacagaccaacaacaagcagcgagattgaaatagtaataaaaaaatttgccaggaggcggaggttgcagtgagccgagatcacaccactgcgctccagcgtgggcggcagagtgagacaccatctcaaaaaaaaaaaaaaaattgccccagggcctgtcgggggcatgggggacaaggggaggggagcattaggacaaatacctaatgcatgcggggcttaaaacctagatgacgggttgataggttgataggtgcagcaaaccaccacggcacttgtatacctatgtaacaaacctgtatgttctgcacaggcatcccagaacttaaagcaaaaaaaaaaaaaaagtatttgacattaaaaaaaaaattgccaacaaaaagaaagtccaggaccagatggattcacagctgaattctatcagacatccaagtaagaactggtaccaacgctattgacactattccacaagacagagaaagagggaatcccctctaaattattctatgaagccaacatcaccctaatatcaaaaccaggaaaggacataacaacaaaaaaagctacagaccaatatccctgatgagcatagatgcaaacattcttgacaaaatactatctaacagaatccaatagcatatcaaaaagataattcatgattatgaaaccatgatcaagtgggtttcataccagggatgcaggggtggtttaacatacacaagtcaataaatgtcggccgggcgcaatggctcatgcctgtaatcccagcactttcggaggccaaggcgggcagatcacgaggtcaggagatcgagaccatcctggctaacacagtgaaaccccgtctctactaaaaatacaaaaaattagctgggcgtgatggcgggcgcctgtagtcccagctactcaggaggctgaggcaggagaacggcgtgaacctgggaggcgcaacttgcagtgagctgagattgcgccactgcactccagcctgggcaacagagcaaggctctgtctcagaaaaagaaaaaaaaagtcatacatcacataaacagaattaaaaacaaaaatcatacgatcatctcaatagatgcagagaaagcatttgacaaaacccagcaaccctttatgattaaaacactcagcaaaattggcatagaagggacatactttaatgtaataaaagtaatctatgacaaacccactgccaacattattctgaatggggaaaagctgaaagcattccccctgagaactagaataagacaaggatgcccactcttacctcttctattcaacatggtactgaaagtcctagccagacaaatcagacaagagaaagaaataaagggcatccaaatcagtaaagaggaagtcaaactttcactgtttgctgatagtacgattgtatacctagaatactataaagacgcctcaaaaaatctcccagaactgatagaaaaaaattcagcaaagtttcaggatacaaaattaatacgcacaaattagtagctctgctacacaccaacagtgaccaagctgagaatcaaatcaataactcaatcctttttacaatagctgtaaaaaaaaaaatacttaggaatatacctaaccagggagatgaaagatctctacaaagaaaactacaaaacattgctgaatgaactcatagagaacacaaacaaatggagacacatcccatgctcatggttgggtagaatcaatattgtaaaaatgaccatctgccaaaagcaatatacaaattcaatgcaactcccatcaaaataccaccatcattcttcacagaactagaaaaaaaatcataaatttcatatggaaccaaaaaagggcctgcatatccaaagcaagattaagcaaagagaacaaatctggtgacactacagtacctgacttcaaactatactataagtccacagacaccaaaagagcatagtactggtgtgaaaataggcacatagaccaatggaacacaatagagaactcagaaataaagccaaatacttatagctaaccaattttcaagaaagcaaacaaaaacataaagtgagaaaaggacaccctattcaacaaatggtgctggaataattggcaagccacaggtaaaagaatgaaattggatcctcatctctcaccttatacaaaaattactcaagatggatcaaagacttaaatctaagacttgaaaccataacaattctagaagataacattagaaaaacccttttagacactgacttaggcaaagactttatgaccaagaacccaaaagcaaatgaaacaaaaacaaagataaacagatggtacttaattaaactaaaagtcttctgcacaacaaaagaagcaatcagcagagtaaacagacaacccacaaagtgggagaaaatctttgcaatctatatatttgacaaaatactaatatccagaatttaggaggaactcaaacaaatcaacaagaaaaaaacaaacaatctcatcaaaaagtgggctaaggacatgaatagacaattctcaaaagaagacatacaaattgccaacaaacatgaaaaaatgctcagtatcactaatgatcaggaaaatacaaattaaacctacaatgtggtactaccttactcccacaagaatggccacaaaaaataaaaaaataataaatgttggtgtgaaagtgatgaaaagggaacactttcacactgctggtgggaatgtaaacaagtacaaccagtatgggaaagtatggtgattccttaaagaattaaaagtagaactaccgtttgacccagcaatcccactactgtgtatctatccagaggaaaagaagtcattataggaaaaaagatacttgtacacacatgtttatagcagcgcaattcacaattgcaaagatatggaaccagtccaaatgcccatcagccaacgagaagataaagaaattgtggtatatgtatacaccatgaaatactactcagccataaaaaggaacaaaataatggcattcatagtgacctgtatggaaatggagaccattattctaagtgaagtagctcaggaatggcaaaccaaacattgtatgttctcactagtaagtgggagctaagctatgaggatataaaggtataagaatgatacagtggggctgggcctggtggttcatgcctgtaatcccagcagtttgggaggccaaggcaggcagatcacctgagatcaggagttcgagaccagcctgaccaacatagtgaaaccctgtctcttctaaaaatacaaatattagctgggagtggtcatgggtgcctgtagtcccagctacttgggaggctgaggcagaagaattgcttgaagccaggaggcagaggttgcagtgagccaaggttgtgccattgcactccagcctgggtgacagagggagactatctcaaaaaaaaaaaaaaaaaaaaagaatgatacagtggactttggggactcggttggagctcggggaagggtgagagtgaggtaagggataaaagactacacacccggtacagtgtacactgcttgcgtgatgggtgcaccaaaatctcggaaatcaccactaaagaactttttttttcttttttgagacggagtttcgctcttgtcgtccaggctagagtgcaatggtgcgatctcggctcaccgcaacctctgcctccagggttcaagcgattctcctgcctcagcctcccgagtagctgggattacaggcatgtgccaccacgccaggctaattttgtatttttagtagagacggggtttctccatgatggccaggcttgtctcgaattgctgacctcaggtgatccacccgcctcggcctcccaaagtgccagattacaggcgtgagccactgcgcctggtccaccaccaaagaacttaaccaagtaccaccagttccccaaaaacctattgaaataaaaaataaataaaattattgtgtgttaaataaatacttctataaacaaatagaaggcatttttgtcagctcagtaagaaataaacacacagacaaaaaaccaatgctgctggctgccatcaagtgactacctgaaatgtcttatagtggcgaagtaaattcacaaatttccattatagggagacatttaatatctgtattttacagacttaactcacataatagcactactaaatgtccctttctattaacatttcagttaaattttcctccaaagtgatatgttcaagtggaggtttcagtaaaattgacacatttggcatataaattaatcatcaggcctaattatgccagtaggtttgttttttaaatcgggaaattggcacaatatatgtataagttgttgccaagacacgtattatatatttgtaatcattgaatattgctctaaattattagtagtgactaatatcagaaataaatttaatagattaccttaattaaatagtatgtatttacaaaacaataagagaaaaaattgtagagatatttagttgcacctgttcaatgattagtttaccaaaaaaactgagatttgaatatgccgagctgtgcatgtaaatgtattatgatgctatgctaatggcttaagagagggaatattcttttaaaaagattattttacatatataacgtaagtatactgaattggaattatatagggaagatggcaaaatataaaacaatttagactaaattatcatcattctgaagtttcacgaggttatagatagaaaatagccatgatttaggtttgtttattccctattttttcattgtttctcactaagatttatttggaaataaatgaaaataatactgaatagatttttatttaaaaccagcaaaattcttttattattatttttttcttaagtcttatcacaccaaagtttaaatgaagggaaaattgaagaagaaagagagataattgatataaatagcacagaagagtagaaagcaagaagactgctttaggctactaattaaaagagacaagataatttgcagtggtgtggattcaagaataaagagaaaaagaatacaacaaattattcttgatgggaattaagactgcttttagtagtaattcttatattagaatgtaagtatgactctaattaaaataatacccacagttgtcaagtagaaatatgcctgtaaaattagcatattgacaagactcgtattttttccaaaatgtacttgtaccattattctccaacagtctaacacatttaatggtatttggaaacctattagaaaaggtgtaagtattgcattccaaaggctatttaaaacctttcccaagagcacacaatttccataagactagataaaaaacttcttatttttacgagtgcattttacctcaatgtaaagcaaatgcaatacactgtctcatgcaacattgttaatttttccaacttaaatcaaagaggctataaggtagataactcaactgaagactgtgatggtggtttgtgctatcagatgtcagaaagatattcctgcagggagaaaagaactaacattctagagtagcagctttcagtgttatctgtgttatctcctcaaaaacctcacaaaatccctgtgaggcagttactgttaccattttacataccaggaaactgagtttcagaaaaaggttatgtaacatttccaaaagttgatctaattagtacatacctggcaaactacagaaacaaccagctattcaaataattgatctttagcaaaatattaaattgtcaaatatctaaacaataacttaaagctacttcagtaattaatttgaaaataattcaacatatttaaaaattttatcttccccattatatatgtaataaagatgattagaataaatttgaaaacaatgaaagaaagaaagaaaaccacagtattgatatgatttaaagaaagcctctcagtatttttgtgagatcctcttcggtgttctttttcttttcattctctgttgttctttctgttctttttgttttctttgtgttaatatttgtggttataatatattatatttatatttaatataaatttaattctgcttccaagctactttaaacctaagtatatgattaactgattctaataatttatcaagtaaatgtaccataaattatttaactcttgaagcatatttaacatttaatggtctcccatgttttgctattataaacaataccaagctgaacaacttgcacataaagtcttttaaacactgtactttagatagatttttcagaagttaaatcactaaatatatttagagcttttgataaatttagtcaaattcctttttaaaaagttaagccaatttatgcaaaagagataaacattcaaatgtttacattacgttagcctgggagcagctccttggctgcagcacctgatgaaagccttcttctttggcaatactcatcgtatcagtactcatcgtatcagtactcatcacatcagtactcatcgcatcaatactcatcacatcagtactcatcgtatcagtactcatcgtatcagtactcatcatatcagtactcatcgcatcagtactcatcatatcagtactcatcgtatcagtactcatcgtatcagtactcatcacatcagtactcatcgcatcaatactcatcgcatcagtactcatcgtatcagtactcatcgtatcagtactcatcacatcagtactcatcgcatcagtactcatcgcatcaatactcatcacatcagtactcatcacatcagtactcatcacatcagtgatgagctttctgtgcagtgagcagcaggacctagatggaacccctggtgtttcagtaacaccaatattccatctctgtcagcaggaagaatttagagaaatgcagaagaattatgcttttgtacttgttcaaacttacccatgaaaacaaaaatagccagggttggttatcttataattaatcttttcttttttctaagtctgaacttcagccaactgcagacagggaaaatgagtctgtgattgctgtatcatccctgaagcaaggcacctaaggatccttactccaacagacaagctttagagcgggcatccatcagcacagatgcaaataaagatcagtgatcaacagagactattaggatgatggaggaaaatgagatctggacaaatatatattgtaaacagcttatttttgctaaggatcagatgacagttaacaccagaacagaacaatgcttaacataattctcaactagcatatatttttgagaaaaaaaaacacattcagcatattcatgtaaggttgcagaaagattcctgaatagggcagacactaatgacatttgctgttaaaactgttccccacaatatgcacacgagaatcccagaatggtacatgaatgaagcccattctttctttttttcttctcctttaaaaaattatgatgaagtatacataacataaaatttactgctttaaccatttatagatgtactatttactggcatgacccattgtttcttgagtatgctaggatgacaccatgtttttaaaaggcacacataagttcctataagaaaagagatgaaagccattatttctgctcagggagatcaaggaaagctcctgagatgctatgacatccaaattgggtcttacagaagaagtaggcgtttctagacaggtaagagaaaatgacacttcacatagaagcccctgagcagtgccagaatcattaaagtgtaggacctgcattttgaggggcagtgagtaattggtctgagtagagcttagactgatattgcattattaataatagggaaatgaatttcacttaaaatttttattttttgaggctctcgcctgtgagacaagagatgcagaatctatttcttacttcatcctgttgccctctcctgaacccatagccacatgtaccttatgagaggaggtggccttaatcagtggcaagcattttctgtaaagagacaggtagtacctgtcttcccgcttcgcacaccatacggtcttggtctttgttgcagctgctcaactctgctgctgtagtgtgaaagctgtcacagacaacctgtagaaaaatgggcaaggggagatgtcacctgcagagtgcactttaccagccctaggactagatcatctctaagataatctcctgcattcatattttagaactctagcattcgtttttttttttttttttttgagacggagtctcgctctgtcgcccaggctggagtgcagtggcgccatctcggctcactgcaagctccgcctcctgggttcacacaattctcctgcctcagcctcctgagtagctgggactacaggctcctgccaccacgcctgtctaattttttgtagttttagtagggacggggtttcaccgtgttagccagatggtctcgatctcctgacctcatgacccacctgcctcagcctcccaaagtgtggggattacaggcgtgagccaccacgcccaccctagatctctgattctatttctattttccaaattgtgttgtttcacatcagcttgattacaaagaagaatatttttggatgaggggatttaaaaaatttacattctattgctcttttccttgcaaagcagtaactgagtgtcttcccttagtctctgcaaacaatcgacgtggacactcagtttctaagttgaaggatatgaattctagattattctctaagaagtcagaacaggaatcacaaagcagctaaagctaatgctctgtagaggaatatggctaaccttactctgggctaatctaggtaatgtgaaatataaattaataataatttacccttgactgtaactacagggattgttttaatggtagatgtgttctcaattattttggttttgtgtggctcaatagcaagggaatgtaactctctggtgtgcgattccatttagtgtccatattaagtcaaacttaagcatgtgtttgaataatgcataacaaatgagaattatcaagaaaaataagattattaatatttctagtccagtaggaactaaagccagcctggaagtggaatgaagacaatgagcccagctcttatcctgcagaatcctgtggaggcataaactaattaaacagttttgctttaataatctttgtatctttctacagggtgaactctcagattgaatagttgcatagaagcagttgggaaatggaagaagcttctcagttgatgaaaaactgtgagatatcagttagcattgtcaatcaaggaaaatttctaaggaaagtctcaattattttaggagatttacctgccaaagttaaggacatgtacctgggagacaggtctatgccgttcttcaaagaggattttgagggcttcaatatttaaagggggaaggatgggatattgagaaatacacaattctcatgtgagggggcagcaggggaaaatagccattcgtgcctttgcctggttcagtgaatctgcttttttttttttttttttttctaattgagatggagtcttcctctgtctctgtcgccaggctggagtgcagtggtgcgatcttggctcactgcaaactccatctcctgggttcaagcgattctcctgcctcagtctcctgagtagctggaatcacaggcatacaccaccacacccggctaatttttgtgtttttagtagagatggggtttcaccatgttggccaggatgatctccatctcttggccttgtgatcctccctcctcggcctcccaaagtgctgggattacaggcacaccgtgctcagccgaatctgtatttttccataagataaggtagacaatagggcagaggaaacaaacagatatgcatttgtctctgctgggcagagggacaactgagttacgtaatgtgtccccacatctgtgaaaacgagctgtcgatttacattgccctggtgaattttaacagaaatgtttagatctcgggaccacaaggaatttccttaagggcaaaatgtgagggaagtatgtagcttttgatctttgtagccatcttttaggaactaaaatgggaggcaggtttgcaggacccagttttcaccttgacttttccctttggcttagtgagtttggggtgctgagtattgacaaagagtcaaactctgtaaaatatttgaagagatttattctgagccaaattcaagtgcccatggcccatgacacagccctcaggaggttctgagaacatgtgcccaaggtggtcggggccagcttggctttctacacttcagggaggcacgaggcttccatcagatacatttaggaaatgcattggtttggtccagaaaggtgcgacaacttgaagcagggacttccagcttataggtagagtaaaacattttctggttgactgtcgagtttatctaaagacctgggatcaatagaaaggaatgtctgggttaagataaaggcttgtggagaccaaagttcttatttgcgggggaagccttcaggcagcaggcttcagagagaataggttgcaaaatgtttcttatcagacatcagacttgaagtctgtgttgctgttagtgctggagaggtagaatgaggcatgtgtgaccagactccccaccatggcctgaaccagtctcaggttaaatttcaagagtgccctggctgacaaggaagtccattcagatggttgggacgaccttagattttatttttggtttactcgagattaatttttctttcacaattataaaacaaagaacactttttaaaaaaatgtaatttttagagctagtttcttaagtctgtgaaggtgtattaaaagatacattaatctcagtttacctagtaagagtgttttcaggaaaaatgcagtttttttgttagtttgttttttgttttttattttttggggggacagagttttgctctgtcgcccaggctggagtgcaatggtgcaatctcagctcactgcaacctccgcctcccaggttcaagtgattctcctgcctcagcttcccgagtagctggaattacaggtgcccgccactaccccctggctaatttttttatttttagtagagatggggtttcaccatgttggccaggctggtctcaaactcctgacctcaagtgatctgcccgtctcagcttcccaaagtcctgggattacaggtgtgagctgccacacctggcaagtaatgtttgtaaatcaacaataaaacacatttttcgattttagtttatgtctctcttcattccgtcctttgtgaggaaaaacgttggtgtatggagacaagttcagggtcggaaccgagagtcagggtgccctgagagccagcccagagagtggcagcacagcttctccttctgtcagaaatggagctggccctgggtacttgacctccgcactagagaccgcattcgcctctgtccctcacaatgagatgacaccatgcaataaggttctctgctgtgaacttcacctcacagtctcaccttactaagtaatgcacgccaggcccacacttctgatacttagaaacactgacggctgagcaaccttagaatcctgggtttaagttgaggaagcgttggtgagcagctagggcctctggctgacttcctggggcagagctgccccatcggcctgagctggttacaacaaaagtcagcaaacttttcttattaagggtcagagggtacatatcagcctttgtgggccattcagtgttgctcacaactcctcttatctgcccttgtgaggcaaaagcaaccatagacaatgtgtaaatgcatgagtgtggttgtgttccaataaaactttattggtgaacacagaaatttgaatttcatatcatttccatgtgttacaaagcagccttgtttttttttcccccaaatttaaaaaatagaaaagtctttttttgtttgtttgtttgagacggagtctctcactcttgtagcccaggctggagcgcagtggcgcgatcttggctcactgcaacctctgtctcccaggttcaagcaattctcctgcctcagcctcccaagtagctgggattacaggcgtgcgccaccgcacccagccacaaaagtcattttcagctcacaggttatgcaggtcatacttggcttatggtctgtagttcaccaaatttcaggttacacaattttgtgggagagaaataaacttctgttttttaaaaataattctgaagtgtcttggtaattagatgaacttagccttaactctaaattttagacgatctctgccatttgtgttagaatccattcattcagatacttctcctttattgccgccagggcatggagggaggatgagctgcacacgtttttctcctttgcttccctcttgcactcctttccttaactactttgattccttgcatggaggtggacctgccaagacatttttaagagcatgctagggacacctcaaggtgtttttataaccatttcaatgagttagaactttttctttttagaagaaatatataaggattatttcttcctcataagttaccaatgaataatttacttactacacatcattatggatggaattgttcccctaaaatttgtattattgaagtcttaacctccaatgagacatatttggagataaagcatttaaagaggtaatttagattaaatgagctcatagtgtggggacctaatttgatagaactgatatcctcataggaagagaaagagaagctgggcatggtggttcaagcctgtaatcccaacactttgggaggccaaggcagaaggattgcttgagcccaggaatttgagaccaaccttggcagcaaggcaaaacttggtctctacaaaaaatgcaaaaaattagccaggcgtggtggcacacgcctgtagtccaaactactaaggaagctgaggtggtaggctcgcttgagcccaggaggtcaaggctgcagtgagccaagatggcaccactgcactgcagcctgggggatagaatgagaccctgcctgaaaaaaaaaagaggaggcaccagagacctctctctctttgcactcacaggggaaaggtcatgtgggaacacagctaggagggagcaatctccaagtgagaaagagggccctcaccaagaaccaagtatgctggcaccggatggtgggtcttccccgccttcagaactgtgagaaatgagaaaatagctttctgttgtctaggtcacaagactgtgtcagactttgttttggcagcctgagcagactaatatattccatatatgggggtgataatagtttgctagtcagccttttttagtaccctttaccttatccttaagcccactagtcaaatagtgtcaacagttttctatatattctttctttggataaaaagaaaacttcatgagcatttttgacatatacctcattgatcagctttgactctcaaaataaactttgaaaaggaacaaaaaggaaacagcagttttgaaagttaggcttttaaaaaactgcaagagccaagcacttgagagaaaatagacttttctgaattccaggtttaaaatagcaagagccagaatttatgttttgaataccaagtctgggtgtatgtcagaaactatggaaggatagaggctacgaagtaaggagaggtttccatgacagagcaaagaaaataggaggatttcctggaacaggagaaggagcttggggattggacgtgggtctgggtagtggaggttttccataggccctcagagaatattttagacataagaggcaaagtgcatgacaggaagtgctgccttttggggaagatgtgactaagctctaagtagcaatggtgggacacagcacacgtggaaagatgctgacatcagcagcagattcactggtattaaaggaggagctcctggctgggcgcggtggctcacgcctgtaatcccagcactttgggaggccgaggcgggcggatcaccaggtcaggagatcgagaccatcctggctaacagggtgaaaccccatctctactaaaaatacaaaaaattagccaggcgtggtggggggcgcctgtagtcccagctactcgggaggctgaggcaggagaatggcaggaacccgggaggcggagcttgcagtgagccgagatcgcgcccctgcactccagcctgggcgacagagccagactccgtctcaaaaaaaaaaaaaaaaaaagaaaagaaagaaagcaaaggaggagctcgtaagcccagtaagactagacatctctgggaaagccaagactgaaggctaggggcctctttcccaatatgtgtgtgtgtttataatctttttgccctcagactaagggaggagaggtgtatctttaagagtgagaatcagttcagatataagtttaagtttttcattgagagaaaccaaaatattacatttaagtatctatgtaagcatctaaattttagagcagggtgactgcattaccttgaagtagtaaagcttcaggtcaatccacataagcagaagctaccctgtgtagaatcagaggaaactgagctcaattatggaaaaattaaaatgttatgtctgcataactaaattgtgactataacgttgactcagctgcagggattggctaatatctataataaaatgaaacaaaacgattgctgcaggtatttatctaaactacttcatgaaacagtcccaataaacttgtcaacagcatgtacccattatagtaactcagatgtgctacaagtttctgaaattctttctgaatcataaaaaagccatattatgttcttggtatgtatatgtattatgttcatggtatgtataccatatgctatggtaagtgaatatttctgtactataatcattgtaaattggtaatacacatatcctgttaggcaggacatttggctacatgtaacattctatttcccaagaactccactaacagaattattttgatagaacccccttaacatttgtaataatataatgtttctttttctcataggggtattcagtttaacaggctcattgatcaattttgatcattccacttttctgttctaacactttcaggggctatcactgcctatgaattttatgaattcctagcccatgcatattggactcactaagacatggctccaatgatcattcaaaattccagatgggctacttattgttccctgataaccctatacatcccgatttgttcttttcctcctactttctccttggaatgccttctccaacctttttagccttctcccaaccccccttgccattcatttcatccatctcaaatgtaccttttccctaaaggatgctcggatctagctttttgaatatgctcgtttcagtatcccataacccgcattttggacttctcttgagacttatcctgttctgtttatattatatttattatgacattttcttatctgtaccccatatggtattctctttgtagtaatgactatgtcttattttttaaaaatctctctcctcatattactgtattgagcatcatctattctgtctatattttttttaaaaaataacagaacaatatagtttaagctgctacaatgtcttcaatctggaaatctgtgtttgctccatgaaagagcactttaaagaaaagacgtgcatgaatttgcatgtgattaatcatatgtcactctgctttcaaatctccttctaggcaagaaaaaagaacagtgaagtgtggaagcttgagagctcagtagggctgcccaaggatatagaaaatgagggagagtgattacagagtaactttccagggatagaagggcccaggatgggggagctcctgctgatggctgagactatgaggacagcctggagagcaggagggagggcatgaacaggaacagagtttaagatatagaggacaactcaaagctacagccccagccctggtgaaaatagagggagaaaagaaaaatacacatatcttaaagatacagttgaaaatagtgtgtgaagtcagtaggagaaattgtatgacaagcaaggagtgtgtgattagtttacctgatagagttgcgattggacactgagctaggttggatgtatagtgggaatagttttgatttttaaacgtacactgcaagtcatctgggtgtaaagcaggttgctatgccgagttccatgcacatagccagttgtcaggcttcatatatgcctataatgggttcccacttcctcacctgtgagagagctgatcaatgggtaaattggtccaagaaactaacaccatttggatacagaaatcacacaaggcactgaaccagaaggagctgctccagatgtgaagcgggctgctaggaaatctgacgcctagcggtgccactgtcactggccgtttgttgttccagaaaaaggccaaaatcctgggagactcttttagatacagcaactgcctaggatagaattgaggctccacaaaggtgttcttcatgtgggaactacaagatcatcagcggagagagccttccaggaaacccgcgtacatcaggctcctcccgttggaggtgaatcctcactccccacaccccccaatgctcccctttatcctggacacagaggggtgctctcaggcttctccctagctctccctgctcaccccatgcttaagagtgaattaaatatgtatgcaaatgtattttgcagattgtacattaaattttaaaatgcaagattttttttttaatcaactttctggctactgggacccagcatattttcactaagagtatcaataatagcatcttcatcttttcttgacaaatagtttggacagttgtgataattttctgatcctccaagcttttattgggatcgacttccttgtctcacctccacgttttcttttttccactatggaccttgtttccattccacactttctctcttcttcttcttcttcttctttttttttttttttttttttttttgacacggagtctcactgtcgcccaggctggagtgcaggggcgcgatctcggctcactgcaagctccgccccccggggttcccgccattctcctgcctcaggggttcccgccattctcctgcctcagcctcccgagtagctggaactacaggcgcccgccaccacgcccggataattttttttgtacttttagtagagacggggtttcaccgtgttagccaggatggtctccatctcctgacctggtgatccgcctgcctcggccccccaaagtgctgggattccaggcgtgagcccccgcgcccggccccccaactccacactttccagtcgctaatgagacattttcctctgcgccccagtgttcagcccccacccccacctacttctactgtcctcgtacttcagcttcaccggagctttccttcgtttaacaggtattttaactcaagtcattccccttctcccttaaaaaaacagaacttggccaaacaaaattggatccaggaaaggcgtgaccgcggatggaggactgtgttacttacctcaactaaggcagaaggtgtttctcatttgcttttctaccattccttcaaactcattctattacgttcccttttcctgccatgacaggcgtcctagttgtccccttaggagttctccgatgtcctgtatgggacccccaacgaaggccatttctcttccatacgaacccttggccatcctcattcctgctctgaaggctgcctgtgctgagcgggtccctgcagggcgactggagcttagcggcgcagcacctgcttgaggcgtgggggccccgccccgcccgggagggcggtcctgctgcctcccccggctcttgccgcccacctttcccatctgctgtcaagactcagcactagcggccgcttcacgaggccccgcaactctggagaacgcagccgacgctctcgagtgtatggaggagccctcaagtttctgcagctcagcacccaagcctggagtgcgctttaaacctgctctgatggaaacaaccccagctccaacagaagcatatatgtgacttgaatttgtggggagcaggggcagtcattgaagctgccgcagaataattactcttgggaattccagtccaggaaagctctctttcaatggaccttctctcagaaatacttcctggtcctctctttcatggcctgaaggtagatgatttggattgatagagacttctgggcttcctctcgctgagtcttgctcagaggaaggggttatttatcttctacatagtcatcaactgagaggacctcagtcaaaacattgaagcaaaagaaaaaagtctcattggacattcttttacatgtgcttccatggcattgtgaacatatggacatagcaatgatcaaagcggtagttttgcatttattgtggccatcatttggctagtgtctgtcttctccactgtgctggaactccatgaaggtcggggccgtctttgttttgctcactacttaattcctaaggtcttacacaaggtctaataggaggcattttaaaattaatgatcagataggccgggtgcggtggctcacgcctgtcatcccagcactttgcaggccgaggcgggcggatcgcgagatcaggagatcgagaccatcctggctaacccattgaaaccccgtctctactaaaaatacaaaaaaaatagccgggtgcggtggcgggcgcctgtagtcccagctactcgggaggctgaggcaggagaacggcgggaacccgggaggcggagcttgcagggagccgagaacacgccaccgcactccagcctgggcgacagagcgagactccgcctcaaaaaaaaaaaaaaagaaaagaaaagaaattcttgtatattgcatgtaagtacggattctctttttatgaactaaaatgaaaacattggatagcctattaacttataattttaacctcttcttagtggtcatttttgttttgtttttaatttttttctttttgtcagaaactgatgaatgctaattagtggtcattattgaggaataagtaaaatatgcatttaattactcattcattcactcagcaaaatcaatgatcacttactactcaggtactgggattatggagataataaaacagctgattcctttcaagcatgtaccacggagtgaatgaaatggacacccaaatacaataaaatgtgaagatctattaggacaaagctatgtgtttgcgagaaacattttctggatgcttacgatattccagcccctttgtgcgcacataatttcttatttgatttttcacaactgtcctgtgagtcatgctttattctctttttcttttcccaatgaaaaaaaactgaggctcagtgaattttaacctcttgaaaaaattggtccattgttcaggcgtaactctgtctgctttcaaagcaaacagttttttgtttatggcacattactgagaactgcagttttaactctctgcgggtggacagcagcacaaaactaattaaggtgcataagtgagaacactaacaataatcataataactgcatctattatttatggagcaactgtgccgtgccaagcatcacgttagctcctttacaaaaataaaccaatctcaccctaaaacaactctaaaccattggtcttagcgttctccttttgtgtaatgggacatcgaggctcctcacattccagtaacttgctcaaagtcatccaggcagtaagagacagagctaggatttgaaatcagttgtgatgatggtaaatctatgctcttaacaattttttaaaaatggctcttctgggattatttggcattaacatgggccagatgaatacagtgtgtttgatggcaggtagaaaatagccttcaggaactttaaaccaggctgcatttcaatgctgaagtttaaaaacttgttttgtttctggctccctatgtactcctgagcttttggtgcccctgaagagatgttttctatcttatattttgtcaggataattcagacaatatttaccaccaatcaacaggtgcagaaaaatccaacagctccctatgggaaacaatggaacattggttagtataaatattaccagcaaggatctcaaaggcctctcatgttcttgttccttcaaccaaaattcattcatccatgggccaatctgatcctaaatttgtaaacaactgtccagtaattaactcactaaaatgaatactattctcaagcaattgcatgcagtttcacaaatgctcttatcatcagttgcccatctctgtgatatctatgagctgttaaggcagtgaaagtggagaagaacatttttcataaacgtgcacatggtgacttacaattcaaggttctaatcaccgcttgaactcttaaaacatcgatttgtctttctaatttagattgtgtgtctcctgagccctgagcacatattctttatgcctggtacagtgccagatccatcagtattacacaaataattaatcttcataatgatagcttgcagaggtagacccgcaattactgaagggcaccttgacatcccagggaaatctgctttgaaaatatatgtgtgtgtggcagataccactgtatatgaaggccaatcatttaattttttaggtcctcagttcctggttgagaaaggaaatagatgctcaactgttggactagaaattcagaaacgtaatcatccatggccctttatattttaaacattcttttaagtttagacaataactttatatttctaggtttcattcactttattctaaggtttgtaatacagaatctgactagattccaatgtataatatttggcgtatctttatgtttcatcccattttggtagactggatattgcacagcaaacattctttcttataaaatggtaccactggcgtagtgttcagggtagcaagagtccagcacagttctttgtccttgtctacttacatctacttacagcacacatggcactctttttttttttttttttgagatggtcttgcccagcccaggctggagtgcagtggtgcaatcttggctcactgcaacccccgcctcctgggttcaagcgattctcctgcctcagcctcctgactagctgggattacaggtgcgcacctccacgcctggctgatttttgtatttttagtagagacagggtttcagcatgttggccaggatggtctggaactcctgacctcctgatccaccagcctcagcctcccaaagtgctgggattaaaggcgtgagccaccatggccagcctcctggcactgtttatatatccagaagcctccagtgggaggacgagggacttgggattcaaatctgtccaccactgcacatgaagcacgtagagcgcccctgtttaatagcttgctcgagtgtacagtgatgtactgtgcagtgagcaggggagaagacacttaacatccccgagcccagttctgtcacctacatcataaaagtactattaacaacttccagcatttaatgagaattagtgcatataagttacttgacaatagagtaactgctcaatcaaggttaattttcttctcttccggttccctctgtctttgcactctctcattctagtagcctcttttcatcggtgcataattccatattatttaaaacaaacattcatcagcggctcatttgtcataaatctggaagaggtgaaattaaagtagttatgtgcatggaaagcccacctttgaagtatttctacctgacccgcatatcccacaactaacttaccactctgtctgaagccacctctgggtgaaggtattaaatgtgcctgttgaaatacaaataccaggagtgggggaaccactctaaagaagtagagatggtctttctccttacagttataatcagttggggaagaaatgttttcaagcttcatacttgattctgagttttctggcataatcacagtgagatatactctcagagtgagtcaccattactgaaaatgtgtcttatcaattagtcgtgccagagagtggagaaaaaagaaaagtaacgttatagaaagccaaaattaaaacagcttctctcgctatatttttcaaaatgttcttaaaggatttcagtatgtcccaagacaatgggttcatggaattccattcaatccatacctgcatgtgcctaccgtgagtgaggctctgaaactggtgttccatgcacaaggccaattcagtctgaataacactgaaggggacagaattaagaggagaatttctgggccacagggtagaaagcgtaagaatggccttgcaatgggcaacctattcagccagggccagcgtgaggacacatacgactctagagggcaggtaggagctgaaagtgaggagagccgaggtctcaccctgaagaggaaaggggaatggaaggtcaactccactaattgagaatattattcagtccaacctcaatacagatttatggtcagtgtcaccctttcctaggaacaggcagcacgctgtggtggaagggtcacagactcggaagaaagcatatctttgatccgtcctaactcagtttctcctaagagacgcagtcttgtgcaatacccttaatctgcctgagcgttagttttcttagctgcaaaatggagtttataattcttgatctgtttcacaaatatgtcataagaataaagaaatatgaactaaaatgttttgacaatgatggattatctaaataccaaccatgcttgtagatgttcttaaagttcatatcaaaggggttaggagaaatgataaaggattactctaggtttgctttttattcaggtatttattcatgtggttgaacatcttaaagccgaagaaagagtaaaatgctggtgaaaactcaggtattattttctgtatcactggatgctagaaatgattactggaaaaaactctttaatgaaacatgctacctgaacactccaggagggagatgagcagaggaaaatgtctttggccttttccccagtgaagcctgatcctttatgacttggctttcatcgatattttgcgcactcaacagagaccctcaaatatgtttattgagaattcactgtgaaaaccgcactcccttaggcactgtgtgaaagggaaagaaaagaaggatgtgagaaagagggatgtttatgcgctttctagagcttctactcagcctggtatgattccaagcagacatttactgtgttacacagatgctatatcaggttctggaagaagttttcctccataaagataacttgcatcctaattgtgttaccatgtcacttaaatagcttctatcagggtcatttctgccagtaaccctcataaggaatcaaggactctctgatgtcagtaaaggcaagatgtcaaggaagctgcaccaactttcttataaggacgggaagagaatatatatctctgcttacccaaagacaaatatttgaacttctttttctgttttctcatcagtggtagaatgctgtgatatttcccttctctttctcttttggccacaccagacaggagaagggaatttaaggaaatgtggagcatagtagttacagggaagatggaaaaagacatgtgttgtttgagtttgtttcaacattgatgaggtgtgttgggcagtatgaagagggagaagagagtgagagcaagaaggaactgtagggaacacaaataggacagaggacagggagaaaaagaagacatgcgtgagattaaaagaaactggccgggcaccgtggctcatgcctgtaaccccagcactttgggaggctgaggtgggcggatcatgaggtcaggagattgagaccatcctggctaacatggtgaaaccccgtctctactaaaaatagaaaaaattagcagagcatggtggcgggcgcctgtagtcccagctactcgggaggctgaggcaggagaatggcctgaacccaggaggcggagcttgcagtgagcggagattgtgccactgcactccagcctgggcaacagagcgagactccgtctcaaaaaaaaaaaaaaaaaaaaaaaaaaaatagaaaagtccctataggcaaggttagcataaggcaaaattgtgaagtacttagtgtgtatcgtccggaacaggtcttttttgctctgcaatccttcacatgctacagaaacattgcagtctcttttatcaggatctagtctatgatttgttatgatctgtcactttgagataaacatgattggtaagtgttaaagtgttactctcccctgtttttcatttcttttattttgttttgccatttttttagggggaggcagatgaatacattttgtgttaaaatttcatgcattgatactatcggggaagtatagacttctaagagaatatctgattgagacagaaaattatgtaatagttcagaacatgaattttgaatttgcctttgggtaagctgatttccctgaggctgtttttttaacgtggaaaatcagagtaataataattgctatctcgtaaatatattttttaaatttctttttaatttttgtccttttttaagtagagacgggttttcaccatgttggccaggctggtctcaaactcctgacctcaagtgatctgcccgcctcggcctcccaaagtgctgggattacaggcgtgagccaccatgcccagcctatttttaaaatttcataaaattttttacactagaaattgttcactatgttgtactattgtcgttattatttttcaactcattttggctatgagcactaaactctaacctgaatatcatagtttcctagtttctgaggcaatttggactaaggcagtttcagaactaacacaagagaatctggaattgtctttataagactgatgtccctgtgtctgaagggaggccacggaagcccagccattccctgacatgcgctccagtttcactcttagagagtaagtaggagtgggcgggctttgtccccagtcctgccacccagcctccttttccctggggtttcctatggaaggagctgcgtgtgtaaagagcaacactcagcgacacatcaaacccagtgtctctctggctggacccgtcctcagcagagcccctagagcgcttctggttccagctgcatttgaaaactggcttttggccgggcgcggtggctcacgcctgtcatcccagcactctgggaggccgaggcgggtggatcacgaggtttggagttcgagaccagcctggctaatatggtgaaaccccgtctctactaaagatacaaaaaattagccgggcgtggtgtccggtgcctgtagtcccagctactcgggaggctgaggcaggagaatcacttgaacctgggaggcggaggttgtagtgagccgagatcgagccactgcactccagcctggcaacagagcgagactctgtctcaaaaaaaaaaaataaataaaaataaataaataataaaactggctttttccaggaggcctgcgtgaggactcttgcttcctcttcactctcttacatctaagatgctggactgaggaggaggctgcggcctgatttgccctcccagccttagctgagaagctggaaagagtggagggagatgaggatttccagcacagcctccacttggcagtccacctttagaggccaggccaggctacagcagggagtctgaggaccaacgggactcagggcagggcctgggttccccggtaagaccaggttgggccatgtactggcaaatgtggtccaacgactgacctaatggaaaaataatttctgtaggcaaaaggtctggccagggtataaggagggacaaaaggaagcggtaggaacatggggaggaagttctctccttataaaaattgtataagatttgaactgttctatctcaacatgtttttgaatgtgtatcattgaaaaacaatggagtcgggtgtggatgctaaaattattttagatagttctttcactgtggcccccattgccccgagaaaatgttccctgagtcccatcaattctaaaaagcactaaacattttgtttaaaaaatagatctggccggtgtggtggctcaggcctgtaatcccagcactctgggaggccaagacgggtggatcacctgaggtcaggagtttgtgaccagcctggacaacatggtgaaaccccgtttctaccaaaaaatacaaaaacttagctgggtgtggtggcgggcaactgtaatcccagctactcaggaggctgaggcaggagggctgcttgaacccaggaggagggggatgcagtgagctgagatcgtgccactgcactccagtctgggtgacagagcaagactccatctcaaaaataaataaataaataaataaaaataaatcgatctgaaaaaaaaattaaggaaatgatgactagaaacttcacaagtgagaagttatttgtccaggagaatcggtgacttactgtatttcttttagttagattgtatcaaggtatgattacaaaaatcaataacaattttatagaaaataaacagagaagcaacaagctaaacctattgagagaacataacttgactgtcattttatgtatataatacagtattatttataaaactgtaatagataagagtcaggtatacagtatacatttcaaagtattaccacagtatttacagttatctataattgtagagttgttaacatgtacttttatctggatttcttaccttaacaaaatacggtcactctatcaatctcagagaaatgtctgtgcaattagtattttggtgttaactttgagtctttataaggtcatatactcatttttcaaaacgaaaagtatttccactgtagaaagatgtctgttgagaaaataaatctcccttcagcacaattttaatttcaaaatgctgcaatacccagaccacaatcctagctagcattaagaaaaatcacatcgtacaaggaattatcactaacaaaggaataaggattttgaaggccgttctcaaggaaagagccgcattgttgagtaggagtaatctcaggggatggctgatatcaaaggaacggtggagtctttctgcttccagtacaggatggagcacaaagcaagattgattgtcatgttttacctgcaatcagggtgagggaaaaaacgaaagggcttttcaagagttgaaggaaaaggctttaaggcagaacaagtggagattagagcttttgtttcacagtgatgtttgctttcatttatacacattcctgatttatacttaataacatgaaagtggctaattttcctattcgtaaaaaatattgctaagtgtgcaaatatgaattactcactgcttctctttaaatgtactcagttaacaggtcaggttttcttttttaattttttttttttgagaccagagtctcactctgtaccccaggctgaagtgcagtggcgcgatcttggctcactgcaaactccgcctcccaggttcaagtgattcttctgcctcagcctcctaagtagctgggattacaggcatgtgcccctacgcccagctaatttttgaatttttagtagagacggggtttcaccatgttggctaggctggtcttgatcccttgacctcgtgatccgcctgcctcggcctccaaaagtgctgggattacaggcgtgaaccactgtgcctggccttaattctttttttttttttaattagcaaacgaaacaatcaacaaggtgaagagacagcccacagaacgggagaaaatatttgcagtttatcgaactgacaagtgattagtaaccagaatatacaaggagtccaaacaactcaaaaacaaaaaaacaaataatctgattttaaaataggcaaaagatctgaacagacatttctcaaaagaagagatacaaatggccaacaggtattaaaaaaaagttcaacatcactaatcatcagagaaattcaaatcaaaataatcatgagctatcatctcatcgcacttaaaatggcttttatcaaaaagacaggcaataagggatgctggcaaggatgtggagaaaggggaaccattgtacactgttggtgggaattaaattagtacaaccactatggagaacggtttggaggttcctcaaaaaactaaaaatagacctaccatatgatccagcaatcccaccgggtatatacacaaaagaaaagcaatcagtctattgaagaggtgtctgcatttccatgtttattgcagcactgttcacaatagccaagatgtggaatcaatctaagtgtccatcagcagacgaatgggtaaatgaaatgtggtacatatatagagagaatggaatattcttcagccataaaaagaatgaaatcatgtcatttacaacaacgtgaatggaactggaggatattatgtgaagtgatgaaataagccaggcacagaaggacaaatattgcatgttcccactcacgtttgggaagtaaaacaatgatcttacggaaatagagagtagaattgtggttatcagagtctggaagggtagtggtgggggagatgaagaaagaattgttaacaggtacaaaaatacatttagatagaaggaataagatgtaatgttcagtagctcaatagggtaaacatagttaacagtaatttattgtgtatttcaaaataactagaagatgggaattggaatgtttctgacacaaagaaatgataaatgcttgaggtgatgggcatcccattaccctgatttgatcattacgtgttgtatgtgttgtatgcttatatcaaaatttcacatgtaccccaaaatatggacgactatgatgtattcaaaaactaaaaataaaaaaattatgaatacgagcaactagcatctaggcaactgggtctgctctgtttaatgatttcaataattcaacaaatatttattgactaccactcatgtattagacactaagatatttgataatgatacaatggtgaatcaacagataaatgatttatcctgatgcttatacattagtaaggaagattaaaaaaactcgtaatcaagttaagtgtgacaggcatcatgtgcttattggaacatgtagaaggggtttctgtgtccctgcaatcaggacaggtctttctgagtctgaagtatgaatcagagttaggtaaagcagagagggaaggcagtttagtttccttggtacaagacagtgtattaaacactgcagtagagagaattgtaaatgataattctgcacttacagaatttgcaattgagtaaatatgagaatattatctaaatgtactgaatgctcattgtgtgctaggtgttattaaatactttacttgtattgattcctttaatcctcacaacaactctatgaaggagttactgttattgaccatctaaaggtgaggaaacagaggaacagaaataggaagtagcttgcacagatcttcctgatctccctcatagccaatgacaggcctaacataacaaatacaatgacaggcctaacatacaaatacttggcgtctgggtccgaagcatgaacttttttttttttttttttttttttttttttttgagacgaagtcttgctctctcacccaggatggagtgcagtggcacgatctcagcttactgcaacctccacctcccaggttcaagcaattccctgccgcagcctcccaagtagctgggattacaggtgcccgccaccacacccggctaatttttggatttttagtagagacggggtttcaccacgttggccaggctggtcacgaactcctgacctaatgatccacctgcctcggcctcctaaagtgctgggattacaggcgtgagccaccgcacccggcctcaaaaacctgcactcttaagaagcattttagtctaagaaaagattgacatatataattgcagatttacaaataactgcaatgcagtaaattacagttactataagagcatccttatgtcggagctcagtggaatgcctagggcttggtgtgccttagctttttaaggaaaatttgtattattttaattatttttatgtacagaaaactcaacagtgtacatttaaccaagtttagtgggaatttctttagcctttgcctttttgagctttggtgcaggtcttcctgtagactagacatcccagtcttgccttccccttgataatgcagtaagggacccccattttacgacacagggcaggcagaaaggtaaccagctcgatgggatccacgtcgtgtgcaatcaccaccagctgagctttcatgttctccaccaaggtggtgacggtgttaactccggctggaaggacaggtggtctcttagtggggacgtcccctttgccggcagctttcttctcagctggggccaacagcctctgccccttctcttgctttgtctttagtctgtacttgtgggccagcttaagcagctgagtagctgtttggcagtccagggcctgggcgaactggtcaatcgcaggaggcactttcagccgcttacagaggatggctctctgccgctgcaacctgatatagcagggccgtttcacaaggtgggcgaggtctcttttgggttggatgtcctgtccaatgccaaaattcttaggccttttctcaaacaggggattcaccactttcttggcctcctgcttcttcatgaccgcaggggccggagccaccttcttccccttggccttctttcctttcggcatcttgagcggcggaaagagagagacgccctttttctttctttctagactctcgctcccatggacttttggtaggtgcactagatagcacacacggttttcccttgaagcaaggcatttctgtctggttgaaagcacactcacggcctctaaatgcttgtcatgcagtctgcaaacaagatgtttaaaggaagttgaaaactcatgtttctccttgtggaagttcatccctctttctgcacaaggtggactacaagaggtccttctggctggaccaaacttattttcaggaagcagctctgaatctgtagaaaagcttgaacattactagttctcagagtgatgctgcataatacaagaagaggctaccttcatttgatgttcctatgattactgtatgtccgcctctaccgtgataccgacttgctaaggattgctaacatttaggcatacttgcatcgtaacaacttaacagtttaactttgactacaaaggccagtgaagggatcgtctactataattttcaattacgttgaaatgtttccacaataactatctttaaacactttatgtgtctagaaatgcaggttacttggtgaaatctaatctcgatggaaagctttgatgctctgtatcaaatgaaaaccaatttaagccatctatgctgcacattaatattaagcaattatattaactgaaagcactgtgaatacatgaattgctttcattaaaaaaagatttccttaattaccttctaagcaaatattctccactaaactttttaagtatttgcaatactcaaataaaataggtaatggagatgtcaatttacatgaaatacatatttctaaaaatctaacttgcattgcaagtttaaaatatgtttacaaaatccagaattaaatataattttataaggctatttttatttggatactgttatgttattcggagaaaacagtatttcttgtttttcatcctttactagctcaaggcttgtcaggatgccactcatatcatattgtgatgttatgatgtatgcccataccactttctgtctcaaggaaaaggtctgtctcctcttatccacattggccgctgtgcccatctctctggtttccatcttgctggcactaaggtagcccctcatgttcacagagaagaaaggctgaggaggtacatgggttttttgtgaccgcaagcttttcagtgcttgtgtgactctaacttctgtgaaatttcttgattttcctcaagtaggacttcagggattcatggaatataaaagatggagctaaaacagactatttcccacatgttcttaggcttaaatgttgaagtgtaaatgtttaagttgtatttatttatttaggacaaattataattgcatgtaattgtggggtgcacaatgatgttgtgatatatgcccacagtttagaatgattgaatcaagccaatgacatatccatctttttttttttttgacagagtcttgctctgttgcccaggctggggtgcagtggcaggatctcagctcactgcaacctccacttcctgggttcaagtgattctcctgcctcagcctcccaagtagctgggactacaggtgcacaccaccatgcccagataatttttttttttgtattttttaatagagatggggtttcaccatgtttgccaggatggtcttgatctcttgaccttgtgagctggctgcctcagcctcccaaagtgctgggattacaggcgtgagccactgtgcccggctccccattttaaatatatatcatttattcctcctgtttaaagcttaataccctttgaccgacacctctcattttccctaccctccagcctctggtaaccaccgttctaccctctgcttctgtgcatttgactttttaaaattccacatgagtgagatcacagggtatttgtctctgtgcctcacttatttcacttaacatagtgtcctccaggttcatccatgttgtaaatgaaataatttctttctttttctttttttctttcttttttttttaaggctgaagaacattccattgtgtgtatatatctcattttctttttccatttatccattgattgacacttagattgattccatgacttggctattgtaaacaatgctgcaacaaacatggaagtgctgatatctcttagacatattaatttcaagtcctaagggtatatagttagaatagggttgctggaacatatggtaatcctatttttagttttctaagggaactccacactgttttctgtaatggctgtgctaatttatattcccaccagtgtacagtgttcccttttcttcacatcctcaccatcacggttgttatctttcctctttttgttgctagctcttctgatagatgatatatcatagttttaatttctatttccctaatgattagtgatattgagcattatatatatatatatatatatatatatatatatatatgtatatatgttggccatttgcatgtcttattttgaaaaatatttattcagtttctttgcccatttttaaattggattttttttttttgctattaacttttttgagctccttatacatttggggtattagttccttatataatgtattgcttgtaaatttttttctgatctgcagattgtctcttcacttgtagttgttttctttgttgtgcaaatattttttagttaactgtaatcttacttgtctatttttgtttttgttatttgatcttttggaggtcaaataaaaaaaaaaaaaaaaaaacattgcccagaccagtgttgtgtagttttctcctctgtgttttcctagtactttttataatttcaggttttacatttaaatctttaattcattttgggtttatttttgtatactctgtgagatagggtgggactaatattattcgtctgcatgtgaatatctcattttctcattgtcctttatgggagagattgttctttacgcattgtgtgtgttcttggcatttttatcaaagtcaattgacgaagggcatcggttcatttttgtgctctctattctgttccattggtcagtgtttctgtttatactagtgtcatgctgttttaattactatggctttgtaatatagtttgaagtcaggtagtgtaagacctctagctttgttcattttgttcaagactgccttggctagtcaggcttttttgtgtgtgtttctgtatgaattttacgatttttttttctatttccatttgcatgaaatatctttttctgttacttcacttttagtctatttgaatctttaatagtgaggtaagtctcttgtaggtagcatatagttgggttttgtttttatacatcctatttctttgtcaagcttctcattttgtattatttttcatattttatttaatcttctatccttatattcttatagctgactgaacttctttaagagaactatattaattttttgttagttatttcatagctctccatttctttagggcctattgttgaagctttatttgtttcttctggagatgtcattattctgattcttcataatctttgtgtccttacattggtgcttgtgcatttgaagaaatggtcacctcttccgtcctttacaggtattctttggcaaagttatactctcactgaagtctagcctgtgattctaggtcggctacctggtaatggcgctaagcaggtagagcttggcgttagactctctagcttgctgagcctctgcctttgctttgagatcagatggatctgagctcttctatttggtgagaccactggctgggttctgcaatcaggcagagatggtagctgggtcctctgattggatgaagacacaatgtgtattccctagttaaatggtactgctgtttgacttttggaatttgggtagggctgcagattgggtcctaagcttaggctgagtcactgattgggagagtcaggatcagctgctaagtttggcagaaatgcacaatattgaggtttacttccctgcctggatgtagctttggtgtgggatttgaggttgaggtgagctgctatttgaactcccagactggggtggtctagcccctgtatgtagccaagatatgccatggtgggtgtctcactccatgagcagggtcttcttgggtctggttcttgggatggacttttaggttgagccaaactcctcttaaatgcccaggtggtgcaagtatagtccctgtgctttgccaaaatactctgtggtaggtatctctcttctcagcaggaggaagttgggggaagcctgaagctgagcatggaggctgagcatctagggatttaagctagattgatctttccactgtgcttctggggtaaccagcttagctttgcaggtgggctatggtactcccacctatgtggtgctgtttaagaggctactactggtacctctcatcaggtgcctctgctgacagtaatgcagagctaccaccaagatacaagccctgtctactgtgagtaacatctcctttctttgcttgtatttgaccccaggtgacctagtcatgccatgatcccatgtttcccatgaggtgagaacagattgggcttcctgagaggcatcttggagtgctagttaagctggatggccaccttatgttttatttttccactttagaaactgtggaccaggggaatcctctctatgtggcactgtgcccattggggagggggaaggggtagcacagtcagagtgacactgttgttacctgtctgatgtagtttttatgtggttctgtctcaggtttatttacaattttggaatttttgccaagatggtcttgtatagaaatagttgctagttgaccttttttttggaagggaagagctgagatgtcctattctgccatcttgctgatatcattccctttgtttcaaaatttttaatataaagctattccctaggttaattgcttctaaatgtgaaggttgtattatatcaaaagatataaatttggagtcacatcaaaagaaagaagaagagtgagaaaaactactttaaatcaattatgaggtcaaatatgtgctccaaaatattttttttcttttgcaatgtaaggatcaattcagaaaaaagaaaatgtttgcagaggcctttcttaaatgatattttttcttaatttttatcaacgattgctgcttgtgtttagttttattttaaacagctttattgaactatgatcgacatacactaaacttaaacatttgacaaattttgacatatatatatatatatacatatatataaaacatcactatagtaaaaaaatgagaatatccatttcccaaaagttttctcttgcccctggtagtctcttgcacctgacctttcctgccacctctcccttccaaaaacagtatatactccatttttttctggcttcttttatttatgtcattcagaatgaatattttgagatttatccaagttgtagcatgttattaatagtttattgtttttggtgttgtgtggtatttcattgaatggttagaccattgatggatatttgggttgttttcagtttttggctattacacataaggctgctatgaatgtttatatacaagcttttatgtggacagggattttaatatttattgggtaatacttagaaatggaacagctggtaggtatatggtaggtttacatcgaacttaaaaagctgtcaaaatgttttccaaagtggcagtgccacctcacattcccatcagcagtatatgagaatgtatattacaccacatcctctccagcacttgtatggtcagtttaaaaaacacttgtatagtctaataggtgcatggtggtagttcattgtggttttaatttgcacttcttttgtgaccaaagatgtatagcattgtttgtcattgatagatcttctgtggtaaagtccctattcacagctttggaccatgatttcaattgggttttttgttttttttcatattattgaaatttaggagccattcatatattttgggtccatctcctatatcagatatataattttcaaatttttttcagtctgtggtttatattttaattttatttatttaattaatttttggtggggggagacagggtcttgctttgtcacccaggcaggagtgcagtggtgtgatcacaactcaccgaagcctcaacctcccaggctcaggtgatcctcccacctcagcctcccgagtaactgggacctatgcctgcatggctaatgttattattttttgtagagacagggtctcactatgttgctcaggttggtcttcaacacttgggctcaaatgagtctcctaccacggcctcccaaagtgctgggattacaaatttgagccactgtgcctggccttaattttcttaataatttttatttttatgtttttgtttgagatggggtctcactctgtcgcccaggctggagtgcagtggtgtgatctcagctcactgcaagctccgcctcccgggttcaggccattctcctgcctcagcctagctgggactcaggtgcccgccactatgcttggctaattttgtttttgtatttttagtagagacggggtttcactgtgttagccaggatggtctcgatctcctgacctcgtgatccgcccgtcttggcctcccaaagtgctgagattacaggtgtgaaccaccgtgcccggctgaagagcaggagttttatgttttgttaaagtacaatttattactactttcttttatggctcatcattttgtcatctgtaagatattgttaccttatctaagatcaccgaggttttttttttcttttgtttttctggaatttttaagggatttggcttagtctcctggagatggagtgagaacaaagatcctagagaaatagtgatggagttatatttgggtgaggctgcaaagaagattggtgtggggttctggaaagagcaggggtctttttcaaaatgatcataagcagtactctggggatgtgtgaaaaactcagaaagaattcctttgactacttggtgctgtttaagaggctactactggccgggcccagtggctcatgcctgtaatcctagcactttgcggggctgaggcgtgcagatcacctgaggtcaggagtacaagatcatcctggccaacatggtgaaaccctgtctctactaaaaatacaaaaaaattacctgggcatggtggcgcacacctgtaatttcagctactcggaggctgagacaagataaattacttgaacccgggaggcagaggttgcagtgagctgagatcgtgacactgccctccatcctggagatcgagactctgcctttaaaaaaaaaaaaaaaaaaaaaagtggctactcccaaggcctagccattttcggttcccaaagatctatggaaatggcagaactggcaacctttaaggaatcacaaaggctaagaaaacaaacatctcagtcttagttacttaactagcacgaactcagatctgaggatgaggggcctccctgatgggcaggaacttggtttgatcatagagtgccaagaatgagctagaatatcctgctagctttgcaatacgcaaacttggtgccaggttaatgcagaattaatttaaagaaaataacaaaatgcaatatctttcatacctcgtagttacaatattaaaactaatacaccacatactatatagattaattccaagttgcataatttctttatactgttcttctcagaatggtagtctaatctaggtctataattcgtgctgacccacggcagtgacctgaaagagttggcactttcagattttgaatatgttgtctcagagcattttctctccacctttgctaaggacacgtctcccctcagctttccgtgtccgtccctgtttcaggcaaggtgagttaggctcacagtgagctccgccagctgtggctgtgtgtatttgtgtgtctgtgtgttgtagtggtaacagcatcagcagtgtttgttgcagatcagctaactctggtaagaagtttcaaagctggttgttatttactttttcgcttttttttttgttccacctgataattttccaagttaattatttatgctgcagaaaaattataatgcgttatgaaagcaattctgtgctgtatcagctttccattttctcttttgatcaaatatcactatatttcatacatattttttcacaattcgcagtttaggattgcagccacttctcggtttcatgatggatggaagtttagtttctagtttttgtatgtttaaataggtctccataggttttaagaatatgtctgatactattttaacaaatctttagcctctggagtatgtattctgtgtgtgtgccaatactactaagaactcagtttctctttaaaacatatttttatgccctccatccctgctccaccccatcatttttcctgggagcagccaaagccatagacagagtaggaatttaaatgtaatttacaaatgctgtccttctcattcctcctcctgtggtgatttgtcccaggcctcctctcttcctcttctaagtctgaatcaatatcagttaacactgtctcgccaacactcctatgagctccacctcacagattagcagagccttttctcatttcagaggtaacagttgaatgtgaatgagttgaatcaggctgatataggtttctactggattttcacttttccacctataaaaatgagaaaaatgagagacagctgaaaaaggaccaaagactgcctctgaggctgtatgagcaagctgcttatccctgaggctgacactgtttcactgacttcaataagatcaaagatggagttggatttgaaccttggtctctcttatttcgagtacattacattagattttgtatttactgtttccttctgttactctaatggaatatgatacggtcatagactatattaattaagacatacttctcaggtataagtgggtatagtataataatgctactgcttttcagtaagtggatcaatttgacacgggaattcacaatttggccattttataaacagaaattataagggactatcttgcagaaaattttgtccaaaattttgattaaaacaggataacaaaataaatttatacaaataaaacttaggaataaagaaggtgacacgtgaccaaacactgcatcaaatttctgttagcacctttaacacatatatcccgacttctaattttttccaaaaacccacatatttttatttatttatatattttttgagatggagtctcgctctatcacccaggctggagtgcagtggcatgatctcagctcactgcaagctctgcctcccaggttcacgccattctcctgcctcagtctcccgtgtagctgggactacaggtgcccgccaccacgcccggctgattttttgtattttcagtagagacggggtttcaccatgttagccaggatggtctcgatctcctgacctcgtgatcagcctgcctaggcctcccaaagtgctgggattacaggcatgagccaccgcacctggcgtccaatttttttatgaaaggtgattttcatatacagtcacaatacttgggcatttgtatgattattcaacaacttgcaaatgatgctgtcaataattttcaagaagaaacaatgctcttccctaatggaagagttgatctggtatattctaatgatctcactcggaacagtgaaatacttaggagagatcttcttcttggactaaatgtaaagacttttaaaaactccagattatactggttatgactttttaataaatatgactttattagatacattttgaagggacttgtgtcttatagaagtataataaaagagcagtctatcatgcgttttaaaccagttactttgaatatcagcctatggcctttaaagctctgaacagttagaactgagctgtatttctgtaattgaaggactgtccacatggcctagagcacattcaaatgatgctcctaaataagcttccagttatcaccgaggcacatgcaaatgggcagaaatttcacatccaatcattgtacaacaggagaaaattctgcttgtataatagaaatgataaccttgaaatacttgagcactcatctttgaggaaagcagaaagacccgaaacctatcatgtgacgagcccgtgaagcctagaatcacagggcagcattaatttcatgggatctagcgaaagaggatctagatggtcattccaagtcctatgtagcctgtttatcatccccattttacatttaaatgtatgcaataggtgtctttacatgagtagactttaaatataggtaatttataggcacaattctttacaaatatttaaacacaatttctaaaattattcaaggttttatcccattgcacagttagactctatttcagttgaaaaatacacgtcaaattgaaaggtgtgaaattatttttttaagccggtactataaattatatgccagaaatatatggtcactttctctagtcatagcaaatgttcaggtaccaagttaactttttaaaaacttttctagaagatccatggaaatcagctgtcacactgcaacaggactcaggaggcctaatatgtgcattcctgatatattcagctgttttaatataaggtagagtaatacagtagaaaacagactacatatggagtcagaaccatatgcagctttcttcactcagtgtttttaaaatgtttaaaaatgcttaacttttttttttttttttttttttttgagacggagactcgctgtgttgcccagcctggagtgcagtggcgcaatctgggctcactgcaagctccgcctcccgggttcccgccattctcctgcctcagcctcccgagcagctgggactacaggtgcccgccaccacacccggctaataaaaatgtttttaaaaacaaaagtgaaccacctttgttcactcattgtttttaaaactttaggtactatttagtgttttggaactttacctgcttattatctgcaacatgaatttaataatatcataaaaactgcatttaaaaagaagatgcactgaggtgatgagtcatatacaactgtgggcaggcaagattttcttgttccctgtacctcgttaactcattagtgcaggatacagattggataacgtctgctagtgaggaactctgtgttaaaatgcctttccataggtgtcactttctcctgtccctgcagtgccaccacaaaagcccagccagctgatggctttagccaatgtggcagcagggagtgtgaggcttctggctttgctaggactcaggccagctgtctccgtcactgggctcagggtgctccctttagttacaaaatcagaccccgtgttgtggagcctgtgcatgtttgcattgctcttttgagttaaaaatcatttagacctaatgagtttaggataaaggactataaacagcctgtcttatccaagttttctgcaatggagtctgccagctcatgcccagctaacgatgtgtctttgaagccattaggtattttctattatttttttgcacataaatatgctttgtggaccttgtagaaagaggtgactagagactggagcaagattcaggtcttcctggatgccctgctaaatgtcatatgattacattggttaaagtcctaattcttcattaataccaacatatgtgatggtgggttgctttcatgtatttctgatagtaatcattagtgctgtttattattaatatgatcattttatccttgatttcctagtatgctgaagaaaagtatgttattcaatcagctttgtgctaaactatagtatatttggcccttaaaagtcctttgcttgctccccgaatgttgaagtttcttactgttccttccaggtcttctcttttcactttccagcataatctcatctgcttttatggcattaattatctctgcattgattacttctaaattcatatctccatgcttaatattttatttgagattcagttccatattaatgtgtctactggattccccagaggcatcttaatatggataaaaaattcatttttatggccaggcacagtggctcacgcctgtaattccagaactttaggaggccgaggtgggcggatcatgaggtcaggagttcgagaccagcctggccaacatggcaaaaccccgtctgtactaaaaatacgaaaattagcctggtgtggtggcaggctcctgtagtcccagctacttgggaggctgaggcaggagaatcacttgaacccgggaggcggaggttgcagtgagccaaaacggtgccattgcactccagcctgggcaacagagtgagaatctgtcccccgccccaaaaaaatcatttttataaccacctacatttattttacttcccgttttaatgaacgaagtcaatagcattatcgcttgcattttcattcggatccactctgctccattctgtcccgtgtcctcttgttcacctgcaaatccacgtagttgctgagtttcagcctattccatctcagggcagagccactgcttggacttccacggcttcacctcagaccctcatccgatgctgccttggctattccaggaaactgctctctgcttctagtcttatcacagctgggaggcaggttctcagccatgctcgccccctacctggaaacagactcggggctgttgtggggggcacggtgagagtgagaccggccctctgggttgtgtgggatccgcccgatactgccacagctgatgctgtcttgaaagcaccacctcccagcaggagcccaaccagcacacaaatagtgcactaaacaaccaaagctaaggaccctcacagagtccacttcaccctcctgccgcctccaccagagcaggtgctggtatccatggctgggagacccacagatgtttcacatcacaggactctgcagacaaccctctttaccagcccatagcctggcagacttgctgggtggctagacccagaagagaaaaaacaatcactgcagttcggctctcaagaagccacatccctaggaaaagggggagagtactacatcaagggaacacccatgggacaaaagactctgaacaacagccttcagccccagaccttccctctgacacagcctacacaaatgagaaggaaccagaaaaccaactctggtaatatgacaaaacaagtttctttaacaccccccaaaatcacactagctcaccagcaatggatccaaaccaagaagaaatccctgattaacctgaaaagaattcagaaggttagttattaagctaaccagggagggctccagagaaaggcaaagcccaatttaaggaagtaaaaaaaaatgacacaagaaatgagggcagaaactttcaatgaaatagatagcataaataaaaaagaatcaaaacttcaggaaacaatggacacacagaaatgcaaaatgctctggaaagtctcagcagtagactcgaacaagcagaagaaagaacttcagagctcaaagacaaggttttcgaattaacccaatgcaacaaagacaaagaaaaaagaataagaatatatgaacaaagcctccaagaagtctgggattgtgttaaatgaccaaacctaagaaaaatcggtattccagaggaagaagagaaaaataaaagtttggaaaacatatttgggggaataatcgaggaatacttccctgactttgctagagacctggacatccaaatacaagaagcacaaagaacacctgggaaattcaccacaaaaagatgattgcctaggcacatggtcatcaggttatctaacgttaagacaaaggaaagcatcctaagagctgtgaggcaaaacaaacaaacaaacaaaacaaaacaaaacaaaaaaccggaacctataaaggaaaacttaccagattaacagcagatttctcagcagaaaccctacaggcgagaaaagatttgtggccctatcttcagcctccttaaacaaaacaattattagccaagaattttgtatccagcaaatctaagcttcataaatgaaggaaagatacagtccttttcagacaaacaaatgctgagagaatttgccactaccaagccagcactacaagaactgctaaaaggagctctaaatcttgaaacaaatcctggaaacatatcaaaacagaacctgtttaaagcataaatctcacaggacctataaaacaaaaatacaattaacaaaacaaaacgaaaaaccgaggtatacaggcgacaataacacaacgaatggaatgatacctcaagtctcaatactagcattgaatgtaaatggcctaaatgctccacttcaaagatacagaattgcagaacggataagccttcaccaaccatctgctgccttcaagagactcacctaacacataaggactcataaaatctcttgctaatttctcctctcctttgctccccaatcctataccagaaggcaagaatgttaatctcttccttaaaattgccgcttgcttcccatctattcaataaagtccaaattacctatcttacgcgtggtttttagttgtctgttgcctacctaatcctctgacctcatattcccaatgtttatatcattcaccatgacttggaacatttcattccttatattatcccttccctagaccttccctctgattatctcttccatctggacctttcccttcctcaatgggcaatttccattcattatttaaggctcagcttaatttactccgttgtggagctcttccttatcactccctagtcagtcgctccctccccagcactgtctctaggcttgtatcacagcaccacaccacctgctgacttgtcagcctggctcatgataccttgctgcctttaatcaagtctggttcttcaattatgatcacagtgtttgctacatagtagaagataaagaaatacttgtctgttggatgaatggtcaagtagcaatgaactttgcctattctttttcaacataagtaacttacaatacttcttttactctcattgaaggtatttaaaataccttcaccacaattttactctcattgaatgtattttaaaatactttcagttcctcacccttcaacatccatctcagccctcagttctactgcagatgcaactatttttaaggcaactttttagatatattgtaaatactgaaaataaaaaataataactatttaaaatgaagatcattcaggaaaacttactatttcatctgcgtttagttcaatatgccaatttcatgtgctgtatttataaaattattctttaataagcatcactaatatatctatgagaagccattaattactgcctctacaaaaggctagtgtcaaaggtaatgttatctcaaaatctgagatgtttaagttccaaactttgtcaattttttttctgtaatcaagaatccacatgttggatgttttactataaaatattactgagtaacatttaacatggatttaaagctggagccaataaatttattatggtgtaaattagcttctttatagaattttctccaaagttgttcgataacatgagagttggaatgaatggaatgtactcaataactatttttaatctatttagttatgaaggaccaaataaatgggtggatggatttctaggcactgtcttgggagacaaaagataaagagtaactaagctgaatttccttcctttggcaaaggctgtcccttaaacaactggtgtattgtcagaaagtgatttaaactatgttcatgcagcaacaagcatctgttttgtaaataaccaaaacattttgttcaggtggcaaagtggtatcttcaatttagaactgaccagcctttggtgaaatgcttctaattaatctaattgcttaattaaatccatgctcaagggatattttttcaaccaaagcctcctaattgtttatcaatgagtgtgattcacattctgctttatctgtgagctccttcttgagctccttaaagatagccaaagacaggggaaaagaggttttagaagcactgcctcacattgaatggaccttagtcggtgcgtagaatagaagctggcaggtcacagtgtttctaagtagagcacagccaaccttaggcttcatcttaccatgaaacatagagcctccttcctttgtgattcacaaagccctttccatcactctggccatccctccagctcttttgcccgtatttccccgtttctgctcttgtttccacacattctctctgaaactctcaaaaataccttctcctccctttccatattttcttcatgtatttttcttttttctttctttttactttttttttttgagacagagtcttgctgtgtcacccaggctggagtgtagtggcgtaatcttggcttactgcaacctctgcctccccagttcaagcaattctcctgactcagcctcctgagtagctgggactacaggcgcccaccaccatgcctggctaattgatatatatatatatatatatatatatatatatatatatatatatatatacacacacacacacacacacacattatatatatatatatatacacacatatataatgtgtgtgtgtatatatatatatatttttttatttttagtagaggtggagtttcaacatgctggccaggctggtcttgagctcctgaccttgtgatccacccgccctggcctcccaaagcgcagggattacagacatgagccaccatgcccggccttcttcatgtatttttcaaattagcaatttatattttttgaaattgaaaataacatccaatagatgaacagcatatcatgccagaagccttgctttcaatgcatttgcatttgctttatcatcgtctcttctgatatcaagcctgagatttctcactctgaaaataattttatctctcgtcaatcttgttatctcagctacatctcttaatgttgattacacccaaatccatgcttactgaacacagtcagatgttctaagtgagctaacatgtgtaaggcatttaatagttgccctggtacttactaagtgacatgaaatttttggctattactattacatcatcatcatcattatcattactattattatcattattcttatgtttctattaggttgcctcagagcaaatcaaatgcatataaccaaatgttttaatccttatgtgtatgttttttaatgtaaattcatagtttccactctcaaacttgtccttcttccttttatgctctgcattgaaccactgttaatttcttaccaacctctgttacatctcttgtattcattttctcttctccacgtagatcctgttgactttggcttacactcatttcatttcactgggattcttctctagatgctcaactttttcttcaaactataattcatcttatctgtggtaatcagtttattttttaaagcatagttctgtttacaagacttctcacaagcttccaagtctctattgcctgttgaataaagttcaccgtccttcatgtgacactgaaggtgttcagtcttccgctttcagataatgtttctggtgcagtcacctgccattttctttcacacctcctagagtgcaacggatctgcatagtatttaatgctcctcattcaatgactatgtagtgaagtgttcctggaagcctggttctagtttaagtgtcttcacccagtgataagactgacacgatcaccgctctgtgattaacattactttgctcacgctcccaactctgctcccttctccaagatacttttgtgctcattcatccacatctgatttatctggtgtgaaactgatcataggtctccttatttatgaagtattctggtaattccgactgaaagtcctctttttcttcttcattctcgtgttatttatttatatctttttcatcgcacttagccttttcactcttggtcagctttctgttcagtgttcagggaatacatgaagattctctgaacccgcgacaaggaatgctgtagcttggaatagtctttctaagtccagaggctgctttcttcaactgtgtgtgcctttcacaagtttccaacttctattcggagccagccagtgctgtgtctactggtacaaaacatagtgttgtaaggctacacgtggaaatgcgcttaaactagaagcaataacagacataggttagtgtaagttatattttttctgtgagttttgaattttgttttcacttttatatttctgcaaatggaagatggcaaaagggctgtaaagaagtgaagatcagtaactgcctcaaatttcaaggcaagaaaaggcagattgttagaaatatccatctgattgaggaaaagtgacatgtttgcttgaggtatgtgtgtaatagattccactgaccactgcacggaatatgtgcagacacagctgatgctgcaaccttatcttaaaaactcatcctttaaaaaataatttccgcatcacaaatatgctttttctttatttcttctcataccattttaccgcctagttaccaatttgctgaaaacgtagtttcacaagaatcctgatttgcagagcacaggtttccttagctcgaggctgtatatatgttctgaaatggaaataaagtctctttcaatgattggattcagtggagctgggtttactgtaaagggaactttaatagctatttttcaatgaacacagaccatctccttttgattaagtttaactattaatgtaatttgacaaggaggtgagaagctcatgcctcatcttcatctgctgtctaaagtaacttaagcaaaagcaaagaaaagaagcagtaaggtgttgctgctggaaaattctgtctgaaaatgctgttatttgaaattatttatagagaattcactgaagtgaactatttcaataatatttttatgttaacgaaggttatcaatgataagatgagccaattataatagtctattataatttaaaatgaatcactggttatcttttcaacacattttatgtccaggagagcagcatatctgcagtgcttaagtgtgcagtctctgaaggcaggtgggaggtttgaattcagtctctagggtccgtacttctgtgaccttgggtggcacagaaggcttatcctttgtctaagccctgacttcctcaatagtaaaacagggataataattctacttacctcaaagttaatactctataggctggacacggtggctcacgcctgtaatcacagcactttgggaggccgaggtgagcagataacctgaggtcagaagttcaagcccagcctggctgacatggtgaaaccccatctctactaaaaatacaaaaattatccaggcatggtggcacgtgcttgtaatcccagctactcgggaggctgaggcagtagaattgcttgaacccgggaggcggagcttgaagtgagccgagatggcgccactgcactccagcctgggtgacagagcgatatttagtctcaaaaaacatttttttaaaaagttaatactctataaattttagctcttattatttatttattgttaagaaaatactcaacattttgaaggaaatgattatatctttcaacattcttgtgacttttctggatatctgctgatttgatgcatttttaaaaatcaaaatatgtaacatgtttttaccttattaatctagcataccatttaaatatacaacagtgtttcttctcttgactaataagtgaacgataatgataattcaacaactacatgatttattatctgatctgaggtttaactttaaatgccaacatcatttttaaggtattttaaaatagactttatttttaaagcagttttgtgttcatagcaaaattgagcagaaaatagagttccaatatatccccacctccaaacattcatagcctcccaactgatagcattttccttgaaagtttaatgattgagggttgcctgcttttacataatttactacgtattttttaaaaattataggccaggcgtggtggctcacgcctgcaatcccagcactttgggaggctgaggcgggtggatcacctaaggtcaggagttcaagaccagcctgggcaacacagtgaaaccccgtctctactaaaaacacaaaaattagccaggcatggtggcgctgcctgtaatcccagctactcgggggactgaggcaggggaatcgcttgaaccttggaggcggaggttgcagtgagccgagaatgcgccagcctgggtgacagagcaagactccatctcaaaagtaaataaataaataaataaataaataaataataaaataaataaaattatgttaatagatgttactatacatgttctggttaaaaacctgagaaagtattttattacatttgaggaatggatttgagagtatttgtacttcaggcaataagaaatattgatcaaatctaaaaaaaaggatcataaaaaagcatttgatactttgtttatccatatatttgcgaacataaatggagttttttggatcagatgacatagtatctatttccttaatctatgggttagaatataaaatgtgattgattacaaaataacttgtttttcatgaaaaaaattagcagctcttgtaaaatgcatctgaataaggagaaagtgtgctacaaatgagtaaagaaaaacgctgactggctatacaaatacactactcattagcacacaaaaactgtctcacttaaccagggaactccttccattccatcaggcatgccttccagagcacgttcttgccttttaaatcatcaatcattgctgccactttagtgagaccaaaagggttaaaactgaaacccagccattccctttcacttctgcaaatgcagctcagctttcccttctctggtctataacaaatgccacccactctttcctctggggtcttctctgatttgtatggccagtccccaacccgcctcctgaacttccatgcaacaatttcagaccctcagcagtggaaagtcttagcatagatgttctgtgagcttcagggcttaacccctcatgaaacttgacctgaatccgtcagtggatagaaaacggatttcatatttagaatcagcataactatttgttacaattttccagagtgtttttttttttctttggagactgagcctcgctctgtccagcccaggctggaatgcagtggtgtgatctccgctcactgcaacctctgcctccaggattcaagcaattctctgcctgagcctcctgagtatctgggattacaggtgtccgccaccatgcccggctaatttttttgtatttttagtagagatggagtttcaccatgttggccaggctggtctcgaactcctgacctcaggtgatccacccactttggcctcccaaagtgctggaattacaggcatgagccactgtgcccagcctctcaatattcttgatattatatgtacttgtattttctttgtatttgaaattatcattaggatggtaatcagacaacttagatgttacaatatctatactaatcacatcacattactttattgttactagtttctgtgaatgtgtcttatcttttaaattaaatccaaagctctttgagccagaaactttgtcttgtatgaggtttgctatataagtatttggagggaaaattgagtgactcgttctttcgtaaaactgttatatcggaacaccacagcttcatgaaaacacattaactagaagttattacactggagttcgatctccaaataatgcgggttgattaagttccattagctctgtggctttaagcaagttccctacttctcaagaccttattgaattcactttacaatagggtgactgggtcaggtgatgtctccagtattctcccttttaaagttatatcacttttcaaaaagaaagtctattctaagaaagaaaatatgactcgaagtctgaatttgcccaagtaccaaagaaaggctaaagttaaagcaaatcttattcatagagagcactagtaaatctatttctttttgatgcttgaatgttttctatgctggaatgttcttggtacatattaggttataaaatgactcatctttaggacatttcagtgcctgagggtattttctttgtaatccatgtattgaaatttgactcttgatagcacatgccaagcacatagttccataatatgattttttaaaattacagataatgaatatcagatgaacacaacagaagacacttagaaataaatcacattttgaccacttttaacaaatactcttagatcagtgtcagatatgagtccttaaagtttggccacaaagataataaacactttatcaaatctctatcttcataatgtgtgctcttctgaagaattattgtctctaacaatgctctcaaagagctaccagaaaggttattaaaatgaaacctatggtcactgtagtcagaatacaaaacaaacacgcatagtcacagttcatttgcatccatttgcacagtgcatttgtttgattttacaaataactgatagatgagtggaaataatattcaatgtcttgcaatttgcagaaaagagaagtgcgactttaatctcagaagaaaatatttcccagagaatgtgaatatctagtatattgtgctatcaaaactctatccctttattttatgtccttgcttgacatttagttggggtttattcaaggattacttgattggaaaagtgcctgcatatttggatgtttaaatacatttgatttatgtctcaagtgacatttgtggaaaacattttctgttttagaaacagtcagggtcagggaggtctcgccgaggggaggcagggactcaaatgaaggactggccacatggagtatgtgtatctcggagaagaacattgctgacctctgtaggaagaaagactggccacatggagcatgtgtatcttggagaagaacattgctgacctctgtaggaagaaagatgtgcacaggtgggtctggtctatgccacatggatcccagtaacagcaaggaggccaatgtaacaggggtagagaagcaaaggagacatttggagaggctgccatattttaaaggttttgtggccatgtttagatttggttataagagtcataggacaccattggtcttctgttttaaagacacctctcgctgctatagtgggaggaaggagaaatattagcatcaggtacaggtgaaccatgtttgtgtctgaggtagatgcccagcaagatgagatgtgcaaggtccatctacataactgtgaaggacaaagggaacgggggcagaggcagggaggggaagccttcagacagttgtgccagtgggagaccttgaaaggagaggtgagctcggacagcctgagacccagcatagtgctgaggaggtgctggcaaggccaatgggggccgcctgggaaaagctgctctctagaagaatcctgttccaggcatgaatagccttgacctagtcctctctcctaggactgggaagagcctgggagagggtggcctggtagtcaggaaagagtggcagctggggactgtcacctgcctgctccttgcagcaggttcttgtgaagggagagccaatcaggcacctccatgggcaccagaacgtgagcgctttggactagggtggaggtagtggaggtggtgaggttttgccggggttctaatatatttaaaggggagaaccaatgatatttactaaaaaataaaatgtgaaatgtcagaattctttgagttgagattttgggtgaatggttatgacaattcctaatggaaattggaaaatatttggaaggaatgggtgtcaaggtcagataaaggcagataagaaactgtttcaggcatgttaagtctgatttaactattcaccatccacttcgatatgtgacaatggcagctggatatattttactgggcggatggtggcctgtggtattccttcagctgccattgatggatagatggcttgtagagcgtgaagaccatcgaggagcggagtacagctgaggaagagaacggggtacattcacgacaccccagtgctccgcagcatctagaaattgggataagaaaatggatctagcgagagagtagaagtagccaggtagaagaataagtagtttatataaaaagagagtgtctgactcagaaaataagtaatgcagatgaaaaggaggggatcgatttgagaaacatctacttaggattggattatgaagtaaagaaaggactttaagaaggaggcagttgtcacttgcttcaaatcctgacaagaggtggaaaggatgatacctcaaatggatcactggatttagcagtgtggaggtcggtggtaatgctgacaaaagtggtttcagtggaacactgatgaaagcattattggagggaatgtaagacagaataagagagcaagtaaaggcagtgagcatagaaactactcagaggaaatcggctgtaacaagaaacaagatggagaattgctgtcctctcaagagagaggcttatgttttaagagagtgacaacacagcaagcttaaatgtttgtgggaaggctctcttagagaaggcaaaaacgtatgatccaggaggaaaaggggagaagcacatgggaaaattcttagaggaatcaataagaggggatgggatctactccatgtgaaatcagttttgctttagagacagcataagtaggtcacctgttttaccaggaggagaggcaaagcgcacaggtccagtgcagctgaagtggtttcctcgctagtggaaatttgtagacattctcttctgattgctttcaaacttctcagtgaaataaggatcaagtcacagttaggcaaagaggtgcggggcgggcatggtggagagttgagaaggggtggtgtgaaagtcactttggtggagggagagtaaatgaacttaatgactcttgtgacactgttgggcagtcctgagtgcctgcttgagttcattcctgtatatttaacgtgaggccaaccagcaggtttaatgtttttctgtattcatttccaagtccttgggtgtgagcacaaacaggcacaggccatatgtaatcattgtggtggttttactaggcagatgtggcacaggaaaaagggcaaggtaatcgagagtaaatagaagggggtggtgacaatgactgatgtaagattgacgctgggaaatgaaggaactgagagctggaggggtgcaattaatagagtgcgggctttgtgggttcaaaatatttagaatgggggccaaaacgctgaaggagacagcaagaaaagattatggaggagacagagtgagtctggatatgaaaaaaagtccagcgtgttatcacaagagacaaactggaagaggctagatgagcagaatagaggacaaagaaccaagagtcctgggtattggtaaaacctgctgtggtctggatgcttgtgtccctctagattcctatgttgaaaccctcatctccaaggtgatggcattaggaggcggggccttttgggatgcgacgggatcatgagggcagaacccttgtgagtgaagttcatgccttatacaagaaagcctagggccttctttcctctccaccgtgaggatgcagtgtgcagtgaactaggtagcgggctgtcaccagacaccacacctgccggcacctggatctcaaactctccagcctccagaactgtgaggaagacattactgttgttcataaaccacccaatctacagtattttgctacagcagccaaaatggacgaagacagatcatttacacgggtagaaaaatcaccaggaatagcgatggtgagaaaaacagcaagccagacacaagaatcacccgtgatgaaggggatggtaaatgactagggagagtgacagaaggcccagtcccctgacatgagccttgatggaactggagcttttagcaggaaccagggcaaatgggcttgaggcagcccagtagtgtgcagggtgtgaaagggaaaaacagccctcagttgacagtgtagtactttcctaggacttctgtagcaaaacaccatgcacttaatgccttcaatcaacaaacatttattctctcacaattatggaagccagaagtctgcagtcagtatcaatgggccaaaatcagggtgtcagcactgtcaccctcccttggtggctccataaggaaaccggttccttgtctctcagcttctggtgactgccagcattcattggcttgtggccacatcactccaatatttagggtcaacattttttgatctccctctgctctgtcttcatatctctttctcctctgtgtgccctaaaatctccctcctcatctcgtaacagaatatgtgtgatgtgtgattgcattcagggtccatctgaacaatccaggacgatctccccatcttgagaacataatcatatctgcaaaggctttcttttcttgccatatgttatggtcacctgcaaagacatatgggcccctgaggtttgatttgaatgttgaggctgatgatgccacacacaagctaagggggtatgaaaggttcattactcacatacttcaggcttctggggagagcaggtgggcctcacaagcagatccaatgtgacctaagaaagcaagggaagaagactggcccaagatgttatagtggttaggggtggggctggggtggggtcaaagttcccatgtgtgggaagggctcgtatggtttgactcccccaccagtgccaagggagggggctccccatctttcctgttggcttatccagatgcgggcataaaggaataccaaggggtgaggcctagaagctgtcaggagtcaaacatcaagaaatggggccagtctgggcctggtggctcatgcctataatcctagctgggaagctgaggcccagaactttgggaggcccagcacttgaggccaggagtctgagaccagcctggccaacatggtgaaaccctgtctctaccaaaatataaaagttagccaggggtggcggcacatgcctgtagtctgtaatcccagttacttgggaggctgaggcagaagaatcacttgagctcaggaggcagaggttgcagtgagccgagctcacaccactgcactccagcctgggtgacagagtgagacccttcctcaaaaaaaaaaaaaaaaaaaaaaaaaaaaaaaaaaaaaagggagggaggccagactactcattacatcatataaggcaattttcccaggttctaaggttctagagattaggaactggctatcctggggtgggtggtagagtccagcctaccacagggagttatgaaacataagcatggtcctcaagggggaactgagattagggttcgatcagaaataggaggggcgtatgaaagaagtcagtgctatagatttttatgtagttaccaatgagctgaaacccatttccccattttatctgttttgttcattgctgtgttctcagcttctacaacagtacttggaacatagttggcatttgataaatattttctaaataaataaatgaataaaaatggacgacatttctaatgtaaagaagttattggaaaatcacaatggaaagttggatttgaaatttaggcatcttcacaaagttcatatgcattattactttaaaattctgtagcgtggaagggagatggcaggggagtatgtcactttgtgacacaaatgaatgaaccatgctaatttcatggaaaaccctatctaaaattctgaaacagaacaccctgcctcccacctgacatagctgcttctgttagcgttttccagccctgtgtctccatgcagaacaaccccaaccgcctgctctgttgtgggtcaacacgctgcctttccaagcactctgaatacaccacagacgtgtcctacccacaaacgtcttcctggtggcgccccttcaaatctaggatctacaatatggaaagaaaattttatttaagtagctgttcataagacactaactgaaagatgtgcgcgcgtgcacacacacacacacacacacgatgtacagtgtcacagaggctctagctatggttattggacttccgaaggatgcagaaggagaaagagagtgataattaaccattacgttagagcaaaacccaagatggttcctgcacgttgattttctacagtgattaactttttttttcttttgtttttgagacggagtctcgctttgtgtcccaggctggagtgcagtggtgcgatcttggctcactgcaacctctgcctcccaggttcaagcaattctactgcctcagcctccctagaagctgggatcccaggtgcctgccaccacacctggctaagttttgtatttctagtagagaaggggtttcaccatgttggccaggctggtcttgaactcctgacctcaggtgatcctttggcctcccaaagtgctgggattacaggcgtgagccactatgcccagcccctctactgcataacttaattaccacaaaataatgcactagatcttcatatttcctcccacggggcactcattcaccaagggactcatttccaaggtctttcaccctatttcttttcttttgaaaaatattcagggaatgagagtttaatataaattgtcattagccaatattcttagccagtcccacacctttaagatggcccgtcttgacgtcttgttcaatggttgccaagccggcaagtgagcatgcacatcctcttggatttcgtccccaaatacaagaggaaagaaacaacgtctcccactgtgaaggatggtggcatcgttagtgggagggtgtccactatatctgtcttcttctactgccctgtattttctcatatcacagcttgacctctctaaatctgatggaaggagaaagactgaagtcagagaggcttgtatctgatggaaggagaaagactgaagtcagagaggcatgtacggagctttgagttttattgtttgacacgcaagggtctgatacttttgtttctggtctcctgtcagggtgccactgacagggccttacactctgctgaatgtagcccgtagccctttggtgagcaccttggcctgcacagaaggcccctgtgctcagcagagtcttcagggagaaattcacttctgggttttctcggcgcctgagaatcctcttcaaggtctcagtcttccatctctagtcctgctctgccctctctctgagttcactaagattgtggatcttctaggttttcacaatggacttttccttctcattttgccctgctctgtgctttgtacttgtgcagcatgcagttgtctgagccctgtgcagagtctcaactcccagccctcttgtttacctagcattgtgaatgcacactgtgattctgggtggcatttctctggagctgtgcattccaggattccggtcaagagagaaataatgctcacatgcttcctcggaggactaggactgaccccgctgcatgcatctgaagaggtaatggtccctacagtgtggtcctttttgggcaaggcttgttaatatctgctctttcattactgtgtagtagggcaaagtcactgcaaatggccgtttcccggtttctaatgtcctgcttttcctagccccctaaggtactttgaccactggttatgaacaaggctgttggctattctattttcaaacagcagtcgtctgttaggaataactatcaatttaatggcgccaatggccatcaaaacaaagaaaattacacagtaagtctgtctttctttctcgaagggaatcatttgcatctcactgtggtaccaagtgtcgccgtttccctcaacatgctggtaaccatcagtcccacaacagagtgaaccaagaatgcagagggctttttgtgctcaatatctttgctttggccaaggaaacactttccataatatcacgtttacttttttaacttttatagtacagagtgaaacatgtagaaaatagtagctgtctcgaaagagatgggaagactaagcctagtgatgaatgaggcacacatagaaagggacaggtgcaccaggacatgggtggggatggtccctgctccatagaaagggacaggtgcaccaggacacgggtggggatggtccctgctcctcatgtctgtgcgaggctttcatttgcaggcttcacagtgctttagaataatgtgttcatggaataaagagaaaggtagcatgggaggaaaatgttttcatacaaagcgaggaaattaaatatcacttgattcaactgggtattttaaggggaaaattacatgattaaatcacacccatggaagtttggtttagaattccattatctaagatggatgaacatttccaaggccctaaactgtgtattagaaagaaatcctaattgcatcaaaataaatgaaatgttatatttttgttattagtttttgagtgcctttcaacccagaagaaaactaaacttgatttaaaaaaaaaaaagctttataacaagatgttagaggtgataaatttaaagtttgaataggaagagcatggtctgggactagaaacactgtaggacagagatgttcctttccacctatttagttattcatttaataacaggctacaggtatcacctatttttttttttttttttgaaactgagtctcagtctctcgcccaggctggagttcagtggtgcaatctaggctcactgcaacctccacctcctgggttcaagcaattctctgcctcagctgggattacaggcgcccgtcaccacacccagctaatttttttgtatttttagtggagacgggttttcaccatcttggccaagctggtcctgaactcctgacctcgtgatccacccgccgcgtcttcccaaagtgctgggattacaggcatgagccaccgctcacggccctatcatccattcttgattgcacatcctcttttggcttccgtgaaagcatactgctatgttttatttctgcctctcttgttacccgccgttatcaatcctaggctcctttctcccatgctcctgcctctatatggtgttgctgaggtccacctttcctctctcatccatcactaaggttgctagaagatccttgttctcagggtgtcactcacacacatgactctcaaatcaaagtagccagcagaacctccacgctgtgatccaatctagaatttccaagctgtcttctggatatttctttttgaatatttgaaccaacagtactgtactttaactcttcctctgctttcttcccaaggctcctagcttctgtgttatcatttgtgacttttccattaagaaaaaatctgttacgagttatttcacctaaaacacggcacattattattttttaatttgtaataattgtgtctgtagtcttaaaagtacaatgctatctcagaatcatataggtatcttttttttttctttttttttgagatggagtcatgctctgttgcccaggctggagtgcagtggcacaatctcggctcactgcaaccttctactctctggttcaagcgattctcctgcctcagcctgccaagtagctgggattacaggcacacatgccaccacgcccagctaatttctgtatttttaatagagacggggtttcaccatgttggccaggatggtgtcaatctcctgacctagtgattcacctgctgggcctccccaaagtgctgggattacaggcatgagccactgtgcccagctgggatctcgttaaagacacagaccccaattaagattggggaatcagagcctttggagacttgggaactcgtgctgtactcatgacttcacgtggttctcatacacactaaggtgagagaaccataaccctggacagcagagaggatactttttgttaattaaatgccacactttatttcaagatattagattaggtattattgacagctgtttgcaaaacccaggaaggcattttatcaatagctactattcattttcagtttgcttcattccaacttgctgtgtattttagttgctctttcggtttaaagcaaatgaaccaactctgactagatttaaacaaaaagcgaatctaagcgaacctattgggagaacactaggttatctcatggagatgtggtaaagtagagaatagggagggactagatcaactccaggtaccttggcagtgaaacctcgtggatcttctcgccactgaatttccttcagttggactttggctcctgtcacttgcaacctgtacttccacccctgctcccaaatttaattttattttttaaaattgcttttaaatgacatgtaataattgtacatatttcggaatacaaagagatatttccatacatggatgtaatgtataattaccatattgtggtaattagcatatctatcatgtataacacaaagaatttatcatttctttgtgttgggaatattcaaaatcctcttttctagctatttgaaaatacacaataaattattgttaactatcatcacccttacagggctatagaaactagagctgactcctatccagttgtaattttgtatctctccttatccttctctcctcctatagtctccaactgacagtaaccataactctactctctgcttctagagctcaatgttttagctcccatacatgggtgagaacatgcggtatttatctttttgtgtctgacttatttcatttaacataatgtcctccaggctcatccttgttgctgtgagtgacaagacttcattcttttttatgacagaatagtatatcattgtgtgtagttaccacactttatccactcatctgatgatagactcttaggctgactccatatcttggctattgtggatagtgcttcagtagacatgggagtgcagatatctctttgagatactgattttctttcttttggatgaatagcgagtagagggattgctagatcatatggtagttctattcttagtttttcgaggaaactccatacggtttttcataatggccatactaatttacaatcccaccaacagtatgtaggagctcccttttctctgcatcctcaccagcatctgttatttttgtcttgttgatagtagccattttaactgggacaagagaatatctcattgtggttttgatttgcatttccataatgattagtgacgtcattttttaaaatgttctttttgcccatttgtatgtccttttttgagaaatgtctttcagattctttggccactgtaaaatcagatttttttttgcttttttatttttttgctgttgtttgaattccttgtatattctgagcattaatctcttgttggatgaatagttcgcaaatattttctcccatcctaaagtggtctttctattctgttgattacttcctttgctgtgcataaggtttttagtttgatatagtctcatttgtctatttttacgtttgttgcttgtacttgtaaagtcttacctataaaagcttcacccagtctcaagtcctaaagtgtttcccccatgttgtcttctaggaattgtatagttttgggtcttaaacttaagtctttaatccattttgaatttattttcatgtatggtgtgagagagagagagagaggtctagatttattcttctgcatatgcatatccacttttcaacgtttttggtgactttgtcaaaaagtcaggtgactgtaaataagagaatttatttatgggttttctagtctgttccattggtttatgtgtctgcttttataccagtgtcatgctgttttgattactagagctttgtagtatattttgaggacaggtagtataatacttccagctttgttctttgtgcttagaattgcattagctattcagggtattttgtggttccatacaagatttggaatattttttctatttctgtgaggaatatcattggtattttgatagtgaaaccagtccagtagtcccatagatagcttttttttggataaacatagaatttgatccttctgttcttaaagcttgaagcttgcatttgttttatctgtgttccttcctcaggatgacattcagggctctcaaaaaaagtatcaaagaggccgggcgcagtggctcacgcctgtaatcccagcactttgggaggccgaggcgggcggatcacgaggtcaggagatcgagaccatcctggctaacatggtgaaaccccgtctctactaaaaatacaaaaaattagctgggcgaggtggcgggtgcccatagtcccagctactcaggaggctgaggcaggagaatggcgaaaacccggggggggggagcctgcagtgagcagagatcgcaccactgcactccagcctgggtgacagagtgagactccgtctcaaaaaaagtatcaaagaactgaaactcacctgatcaccacatccagacaatgagatgccaaacccctcattcatcatgattactttcttgctcctccctagttcctcccttttcttagacattgtcacatttcttccctgctatataaaccactagttatagccagtcagggaaatggatttgatactaatctcccatctcctttgctgcagcactccgttaaatccttcttccttggcaatactcattgtttcagtgactggctttctgtgtggcaagcagcaggacctagactgaacccctgtgctttggtagcaacaggaattgcactaaatctgtagcttgctttgattaagatggtcattttaacaatattgactgttccaatctgaacatggaatttttcttttttggtgggtgtgtccttttcaatttttctcatcggtgttttgtagttttcattgtagaggtcttttatctccttggttaaatttatttctaggtactttatttttttgtagctattaaaaatgggattgcttttttgatttcttcagctagtttgttattggtatatagacttgctattaattcttatatgttgattttatattctgcaactttaccaaattcactgatcagttccaagaattctgtggtgaagtctttaggtttttctctatataagattatgtcatctgcaaagagggacaatttgattttctcttttccaattttgctgtattgtattgctttctcttgcttaactgccctggctaggaattccagtacagtgttgaataagagtagtgaaaatgggcgttcttgtctggttccagctcctagaggaaaagtttttccccattcagtatgctgtcagctgtgggtttgttacatacggcctttattattttgaggtacactccttccatgcctaatttattgagaattttttgtcatgaagggatgttgagttttatcaggtgctttttctgtatctattgagatgatcctatggcttttgcccttaattccgttgatgtgatgtatcacatttattgatttgggtataccaaaacatccttgcgtttttaggactaatcccatttgaacatgggtgtataatttttttgatgtgctgttagattcagtttgctggtattttgttcaggatttttgcatttaggtgcatcagggatactgatctgtagttttgtcgctattgcttttgtgtcctggtctggtttgggtagcagagtaatgctggtctgctagaagaagtttggaaatgatcccttctcttccatttttttgaagagcttgtgtcaaattggtattagttctttaaatctttgggagaattcagcagtggagccaccaggtcctgggcttttctttgatgggagactttttatgatggcttcaatcatattgcccattattggtttgttgaggttttctttttcttcatggtttcatgttggtaggttgtatgtgtgcagggatttattcatttcttctagtttttcctatttgctggtggatagttgttcataatagtctctaatgattgtttgtatttctgtggtctcagttgttagtcttcttttttgtttctgattttatttatttgggtcttctctctcttctcttagtttagctaacagtttatcaatttttgtttgtcttttcaaaaaggcaagttttcatttcatcgatcttttgtaatttttttttagtctctactatgtttagttctgctctgatctttatttatttattttctagtttaaaattttgggtttagtttgttcttcctttactagttcattgatgtgcattgttagattgtttatttgaaatctttctacttttttaaagcaggcatttatttctataaatttattcctggggatcaacttacctctttctgtgtggtgaggagtgtctcttgggatgagccgatcccagccaggctcttcactttcctctttatgctgccatctccagtctctgtgcatcagaaggtctttatcactttcttgctgaattccagtgttttctcctatacactctatttgatgtgttgttttctaattgttttggtcctttgtggagtaggagagcactgggcatctcttatcagccttcttgatgacatctggataggacaatattgatcaatgatatatctagaagcaattttgaataaataatatagtgttataggttataattaaatatgtaaaccaaaaataaataaaggaaaggaagaaaaacctccctttttttcagaggcagggagtttttatttttggcttctgtaatggtatttcaccaagttttaaaggtattaactttattaacccgcaacattcatcattttaaaggcgtatatagaaactatcaaaatgggtcagaaacaaggtttgcgatactcataattatcttcaacagtggcaatatttaaccttttgagtcaatctcaacagattggcaatataacataatatatattgataagtgtcattcttgataaaaaatcaaattatttttctatttacaatttttagaaaaggtttaatgtaaaaatatttttcttctttatatatttccctgccatgataatgttaaaacatatcaagatgctcctcaaagtttaggagtgaacagcataacattccattttagttgaagcattctttcacatagccaacatattttttcaagacactctaagaactcgtgaggatactacaggaaaaatgttcctcttgcctactgagcttttagtcatattttccctcaaacttttctaaattaaacattgttataactgggtttgtttttttttttgaaatttaattttccacggtgcagtcctcaagttattcttttattcggagccactccttcagtttcaacttgctgagcaggcaagcaactgcttttggtttctatggaaactggattcctgtggctgcctgtaggtattctcgttccaccaaccttttgttgtgttgtggtatccagtgatttaggtggaaaagtacaagttattcttccatgatggatatgatatggtcataacaggctaggatctaatcggacccagagaactgagagactggaaggtacatcaggaaggctgcaatgtgttttatacaaattgtatgctgtcctagtaacttttccatcagaggtcttatggattgggagtgaagaatcttctgctgcctgagataacaagtaggaaccctcctgccagctacttaatttctttagaatgtgttggagaatgttaaatacattggaaatcttgagtgctgaaagcttttcttttaatgcttctgaggtaatttcttccagtagaaaaagctttgaagtaaatgcatcgatatggccaatgtaaaatatctgttggaatgcaatcaacttccagtccacaagcgacaacgttcactttcagtcagagcttcaactccataaccagcttgattctctacttctggtagtacataaactggaaattgttttccgattttcttctgtttcttagaacgtggtcttgtctccatcctccggacactgcagcacatgagtaacaacaggtcttgcaggctaaataacttatgaataaagtttccttcctgaggagctaggtattccgacgtatcttcaacatagtcctgaagttcatatggcaatcgtccttttggcttctgaaatgcagaaggccatccaatttcggccaactagaggcatctgaagggacagaccgttgctcagaaacagagggctgtttagaattttctaaattcattaagggcaatttgggtacttttctggaaattggctttaagagctcatcctgcattttaaaaatttctccaacaggatcaaattttttatatactcatttgataggtttttttaaaaaaaaatacatgacttgccaggcgtggtggctcacgcttgtaatcccaacacttcgggaggctgaggaaggtggatcacctgacgtcaggagttcgagaccagcctgaccaatgtggagaaagcccatctctactaaaaatacaaaaaaaaaaaaaaaaatggctgggtgtggtggcgcatgcctgtaatcccagctacttgagaggctgaggcaggagaattgcttgaacctgggaggcagaggttgcagtgagctgagatcgtgccactgcactccagcctggggcaacaagaaagaaactccgcctcaaaaaaaattaaataaataaaaagtaaaaaaataaaaacacatgactcttctggactacaagcagtattagtctggttttctgcagaagcctgtcctgaggaagaatttgggctagctggtcaagaatttaagttggaacccatgacagctgtctttccgtcactattatttttacactctgtatcaataattaaacactccttatctgtatcactgctgcagagaactgtatcttcagttttagctgcttctgatgtcacagtcttttcctttgagttgtctaggttttccagaacattgggtctttcagcatcaacatgtaccatatctatagtcatatcatatttattagcagtttcaatttcctgagaattttctaactgtaaggcatcagatgttttcaagtcactatcttgcctcgaagacttgtcagtatttgatacctttttgccacatgattcaaatccctggtcatctttatttttgcactctttagggccaccatccataccagtgaccagttgtttctccttttgcgactgttcaatgagaatctgagataaacttctagaattagcagaaatgtctggtgcacttggtgccacaggtgtagttcctgctttgggggctgtaggagcatctgtcacgttagttactgtggaagtacttgctggacttcttggctttgatgctttggtggtggttactccaaaagtttcaagttttgtaacatcaccatcaaaatccagatacaagttttcaagagtctcagtgttttggcactcactacttcacagggcatgtccatttcagatataaactcttcaaggataaacctcttttctatgcctggtgggagagtcaaagatccctgttcttaaggatgtaaatatatacacagataatatagttattgaataacttgggtttgagggaagtaaaaatagttgttttctagcataaaagtaattcctttttcaaagcttcaaattaattttggatcagtgggaggatcatttttaaacttaataaatgagtgaaagtccagttaaaacagaagaataagaacagttcattttaagtagactctcacaagcttggtcaaatcaaatgctctaggaccttctcgtatattttaggatactttacttgtatttgggagatgattccccaggagtatttcatatattcacatgtggtgtaaacagagactctggcagcttttctttcaaatgatcttttcaaggatattgccattgtgaacagctttggaagttaaggtagcttttccctctgtggtagagggcaggttttcttggtgtttaggaaaattaaaataatgactacttttaggacaaagtttgagcaaacttacttgaggtctgatatggtttggctgtgacctcacccaaatctcatcttgaattgtagctcccacaattcccatgtgttgtgggagatacctggtgggagttaattgaatcatgggggtaggcctttcccatgctattctcgtgatagtgaataggtctcatgagatctagcggtttcacaaaggggagtttccctgcacaagttctcttttcttgtctgccgccatgtgagatgtgccttttacttccagccatgattgtgaggcctccccagccatgtggaactgtaagtccattaaaactctttcttttgtatatgcccagtctcaggtgtgtctttatcagcagcatgaaaacagactaatacaaggtccattataaatgactggagtttcctaagctccagcttccatagctatgaagaaaatccactcagtatacaacttttcccttttttagcctaggagtcttgtgtcttttgccaacatccatgaaacaatgataatgtaactcattagattgcaagtagagtaaacctcagaccctttacaattaagtgtttctccacagtttacatgaaattgaaaaatgaaggcaccaagaatttgtttttttctccttacacacacatctgggcttttacaattgtagggaccagccccacagggtcggagggtttttctccccgtgtgcggagatgagacattgtagaaataaagacacaagacaaagagataaaagaaaagacagctgggcctgggggaccactaccaccaagatgcggagaccggtagtggccctgaatgcctggctgcgctgttatttattggatacaaggcaaaaggggcagggtaaggagtgtgagtcatctctaatgattgacaaggtcacatgagtcatgtgtccactggacagggggcccttccctgtttggcagccgaggtggagagacagagagagagagaggacacagcctacgccattatttcttcatatcagaggtttttagtactttcactaattttgctacggctatctagaaggcagagccaggtgtacaggatggaacataaaagtggactaggagtgtgaccactaaagcacagcatcacagggagatggttaggcctccagataactgtgggcaggcctgactgatgtcaggccctccactagaggtggaggagtagagtcttctctaaactccaccagggaaagggagactccctttcccagtctgctaagtagtgggtgtttttccttggcactgacgctaccgctagaccacagtccacttggcaacgggcgtcttcccagacgctggcgttatcactagaccaaggagccctctggtggccctgtctgggcgtgacagaaggctcgcattcttgtcttctggtcacttctcactatgtcctgtctctgtatggcctagtttttcctaggttatgatcatagagcaaggattattataatattggaataaagagtaattgctacaaactaatgattaatgatattcatatataatcatatctatgatctatatctagtataactattcttattttatatattttattatactggaacagcttgttgccttggtctcttgcctcggcacctgggtggcttgccgcccacatgcaatagctttctagctatttcttctgtagcatataagagttcagcaaacatttactgggtcccaatcttgtaacagatactcttatagatcctagaaatcccaagataaataaaacatgattcttgacccaaaatgcttccaatgaatagaagaaacaatgcataaagacgcatgacacagaaacagtatttttccttccttctttccttccttccttccttcctttctttttctttcttagattgggtctcactccgtcacccaggataaagtgcagtggcacagtcttggctcgctgcaacctccgactcctgagttcaagtgattctcctgccttagcctcctgagtagctgggattacagccgtgcaccaccacgcccggccaatttttttgtatttttagtagagacgggttttgccatgttggccagggtggtctccaactcctgacctcaggttatctgcctgccttggcctcccaaaatgctgggattacaggcgtgagccactgtgcctggcataaacagtatttttcatagcatgggatataagtgacgacagcaacagcaactttttttttttttgagatggagtcttgcttgttacccaggctggagagcagtggtgtgatctcggctcactgcaacctccacctcccaggttctagcgattctggttcctcagcttccccagtaactgggtttacaggcgcccgccaccatgtgccagctaatttttgtattttcagtagagatggggtttcaccatattgcccaggctggtctcaaactcctgacctcatgatccacctgccttggcctcccaaagtgctgggattacaggtgtgagccaccgcacccagccaatgacagcaacattcaaggggtgctctgagagcacactgaggtgcacttagcctgtcgtgaaagttcaagagatggttcttgaagttgatggtcactgaatgcggttttgcaggagattgaatttgaaaagctaccttaccttccgaggctgttcccagtgcaaatatccttgaaaagatcattcaaaaacatgtgaaaagagtgtttctgacggaaggacatatacagaaacataaaatagcatgatgtgaatcaaggaactaaacaccaactgctgttactagtttgtggagttccttgtgtggagcagtaggaagttgaagctggagtttgctatgcatgctgcgttaaggaactcagattttagcctttatgccagttgcctccagacttttttttttttttagatggagcctcgctctgttgcccaggctggagtccagtggtacaatctcggctcactggaacatccgcctcccaggttcaagcaattctctgcctctgcctccagagtagctaggactacaggcgcctgccaccatgcccagctaatttttgtatttttagtggaaacggggtttcaccctcttagccaggctgttcttgaactcctgacctcgtgatccacccacctcggcctcccaaagtgctgggattacaggcatgagtagctggccttaggcttttctgattatacatttatttagtaaaactttctcaagcagtcacctctaatatatctatatgtatttataaatttctctacacgttgtatggtctccccatatattaaatgttagtattttattttattttataaaacgaaataaaaatagataaagttggccaggcgaggtggctcacgactgtaatcccagcacttctggaggccgaggcgggtggatcacgaggtcaggagatggagaccatcctggcgaacacggtgaaaccccgtctccactgaaaatacaaacaaaaaaaaagaaaaaaggaaaaaaaaattagccgggcgtggtggcgggcgcctgtggtcccagctactcgggaggctgaggcaggagaatggcgtgaacccaggaggcagagccgcagtgagccgagattgtgcccctgcactacagcttgggcgaaagagcaagactccgtctcaaaaaaaaaaaaaatagataaagtttctcatattttcttctacacctcaactgattgtctttctcactctccttgagggccacatttagtctgcttgcaggtgctaacacggggaatgatgatttggtcagattcatgttttcaatcactcctcacagtggaagataagagttgagggatgcaggattcaaggagggaagtgtaggaaccaagatattatgatggatcaagcaagagaaagtcaggatctgactgagagagcaggcatggagtgaaaaggagggctaaatttgagaaatacctaggtagtagaattggtacgatccgcccattgagtaggggtggggagtggctctgagaggccggagtgaggcctgagtgaagggatgggagaagcaaatccattgagtagggatggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggccggactgaagggatgggagaagcaaatccattgagtaggggtggggagtggctctgagaggccagagtgaggcctgagtgaagggatgggagaagcaaatccattgagtaggggtggggagtggctctgagaggccggagtgaggccggactgaagggatgggagaagcaaatccattgagtaggggtggggagtggctctgagaggccggagtgaggcctgagtgaagggatgggagaagcaagtccattgagtaggggtggggagtggctctgagaggccggagtgaggccggactgaagggatgggagaagcaaatccattgagtaggggtggggagtggctctgagaggccggagtgaggcctgagtgaagggatgggagaagcaaatccattgagtaggggtggggagtggctctgagaggccagagtgaggccggactgaagggatgggagaagcaaatccattgagtaggggtggggagtggctctgagaggccggagtgaggccggactgaagggatgggagaagcaaatccattgagtaggggtggggagtggctctgagaggccggagcgaggcctgagtgaagggatgggagaagcaaatccattgagtaggggtggggagtggctctgagaggccggagcgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggagtgaggcctgagtgaagggatgggagaagcaaatccattgagtaggggtggggagtggctctgagaggccggaagggatgggagaagcaaatggcgcacattgtgtttcggtgactgagagaatagtggttatgtttaatgagacagaagattcagtggataagcagattttagtggtgggttcaattaagaaattgacctcatctttatacagattcacttccttttaattttctctcaacacactcatccaaaatttggttgtgttgtttttctgctgaacaacctgtattattctcctttcttttccaaatctccacattttggcccaacccgtgttccatggtgaattcagacagtaaaagaagcaactgtttttcaagtgccttctttgttatttataacacaatgctttttattccaattttgtagttgacttcttttctctaatagattattgtttagtcattgcagatcctgttattcttcccagcaaacaacctcaaagtttcactggcttacaataaataaaatttatttcttgcttgtgtaatttaattttatttcatgtacttttatcccaatgtacatttcaatttgggacccagaccaaaatagccattcaagtgcgaggggtttattttgtagatgatccgaaaagaataggaagtgagatagggaagaaaataatgacaaaaaaggctttattttcaagggcgttatcactgtggacaactggagcttaatcctactgcggaaaccgagaagccagggtaaaatgtgtacctgagtaatcccacccgtgggccaaggtaattgtaatatttacacaccaatttccatcagccattggtcgtggctgtacctatgagtgatcactttccagcatttcaggcctagaaaaagtagccaaggaggtttcagagtcagagaaagccctcgtgcagaaaatgtacatgctagcatttacaaatcagtcaggtatgcatcgatgtggttagagtaaaaggacatagagaggaatccactaaatccatccaggaataaacaaataaaataggaaaaaaaaacccactgttgacataagttaatacttttattttaccactatttctttctttagcccttttattcagttacggctacttgtgtacattaggtaggtagtgtgcaaattttacagtatgcattaactcaaattctatatttgtagtaactaaaacacgccttatttttcatctctatgctattccctcccctttccccagtttctctgtgtatgaagctcgactgacttgtcaaaagctccctaaagtgatgtttttacaataaagtctctcctaaacttcagttaggatcaatcactctctactggctgctcctgtagaattttatctgtagttttgttttgtcatcttatcactttataatattatttacaatctgtctgttaatgtattgtgcacagggctgggcgcagtggctcacacctgtaatcccagcactttgggaggctgaggtgggtggatcacgaggtcaggagttcaagaccatcctggttaacacgatgaaaccccgtctctactaaaaatacaaaaaattacccggcgtggtagcgggtgcctgtagtcccagctactcgagaggttgaggcaggagaaaagctcaccaggaggttgcagtaagccgagatcgcgccactgcactccagcctgggtgacagagcgagattttgtcttaaaaaaaaatatatatatatatatatacacacacacacacacacacacacacatatatatatagaacacctttaagatgatttgtgtcttacttctttttacttatcccatgattgtcacaataaaggtttgctcacatcataagcaaatacctaaatagacatgcctgattttcttacaattatggaagtgaatcttactttgaaaaaaaatcataaatgccccacatttttcaatgtgcttttggacatttcttaataactatgtttttataatattatatatgttaaggcacttacaattttaatgtgtagttatatgtaaaatcacattgtatcgagtaagcattatcaaataattctttatgatgaaattaatttatgagtttctaataaatactacagtattgttggccagaaagcactaatgaaaataaattaaaggtattgtttgttactttaaaggctaggaatttctaatataaagaaatgtaaggaatagttcataatttaagaacacagccacttcaaattgtaaaaaagaattatctattgttaaagcgaactaaatatggcctgggaaggactctatacttctatacttgagtccttgtagaggaaccataacctaacttaataggacaacaagattgaaaacctaatttaggagtatgtacgtggaacaatcgccagtccagcagccatacttcagccactcacacactgctgcgtgttcaaactgtgttcgagtaaggcaaacttgtaaccagtccagttgtttgtgtaactcacttccgatttctgtacatctttttcctttttttgtctacaaattttcttccacgatgtggctgtgctggagtctctctgaatctgctgcgattctgggagctgattcacgcatcattcattgctcaagtaaactcctttaaatttaattcagctggccgggtgcggtggctcacgcctgtaatcccagcactttgggagtctgaggagggcagatcacctgaggtcaggagttcgagaccagcctgaccaacatggtgaaactccatctctactaaaaatacaaaaattagccaggcgtggtggtgcgtgcctgtaatcccagctacttgggaggctgaggcaggagaatcgcttgaatccgggaggtggaggttgcagtgagcagatatcgtgccactacactccagcctgggcaacaaaagcaaaacccgtctcaaaaaacccaaaagtttaattctactgaagtttttctgttaacactgtgttattattttatcttttgatgaaaggcaaatgatataaacaagaacttggaatatttgtgaataatgtataaataaatagtttctgtttattctctgtattctgttaaaagtttttgctctgctcaatatatctggccataaaattcttttaaatcctgtataattttaaaagcaaatttgatgcatgtgcaacttattttattttattttttttgaggctgtttgttacaatggaaattgccttaacaagtctcatgtggcacatgtggtgcccagagcattctgaaagttatggttttgaaagcagtcgttgtggcgacattgtcctaattaaagttctcgggcagttttgccgacattcaaaaccatcttccatttttatccttttgtggtaatatttatcatttataaaaaggaattccaacacctcttttctatgtataatctcccaacgttcctggtcaaagcagtttgctcccaaattaccagaagtggtctcgttgcggcagcagagctcccctggtgcacttctactcacgggtttgttgaacgtgtagctttacccaccttgaggcagaactgcatgtgcccgtgttggcgctgacgcatgatgtgtggtgcacggatggagcaaaggtgaatatctccccacagcagacctccgaggttcataaattatttatcacatacttcagtgtgctgccacagtgatcagggccagtttccaatatggagacaagagctctttaatcacgctcttccctgcaaaagaaaaagattggcatttaacagagagctgtaagacaggatagggatgtgactgcagggaaacctccacttggaataggagtcgctggtcagttctagacccaatggcatggacttatgtagtaatagtagtaagagttcctgaagatagtttcaatctattgccagcattctgtaggtctttataacaagcaggaaatggatacacatgtctctgttccataattagaaaagtatcaccattttcctgggacaaaaatatgtaagtttaaacatttttagtgccaggtcagtagtcacgatttaccaacagcattttttattttaaaaatacagttagtgactacaccattggctaacaaactgagacttaaagcattctctagatgcaaatgctacaaataaatcaaattattaggcatattcactaatacttacaaacttaacttcatatataaagcaaggtagatcaccagtgtggccatgcaaacagggtttgaggacttcaatatttaaagcaagttagtccaacccacagcccaagggccacatgcagcccaggatggctttgaatgaggcccaacacaaattagcaaattactaaacttacttaaaatgatgggattttattttttgccattttttggtttgtgtgtttggtttttagctcatcagctttgttagtgttagtgtattttatgtgtggcccaagacaatacttccaatgtggcccagggaagccaaaagattggacactcctgatttaaagggaaaagggagggcagatgaagaaagaggataaaaaaaagagagagaaggtagacaaaacaggaaagtggttagtctttggaggctttgattagcacttactgaatctacattttacatgtgaaaggagtgggtagcgaaacagtgaattatgcatagtgctcagtgcgtctgcatttttgcataagataaagtaaacatagaggaggtgctcaaatatgcattcctctcaggtgagccaagggatgccctctaggcctgtctttgtcaaggtaccggtgaagataagctgttagtttacattgtcaaggtgaaatagaacagcgttctgttttagggtaaagctcttggggcccacgaggaatttccttgtgagcaatttgtgaaggaggccaccgggggagacatgtggccttctgtctttgcagctatctacttaggaacaaaatggaaggcagtttttgcatgatgcagttactgagcttcacttttccctttggcatagtgagtttggggtcctgagatttttatattcctttcacagcctcactatacttgaattaaaatacaatctacatgttaaaactgaccacatcattctttcctgtgtgtcttcaaaggatttaaggcccatccagataatccaagatgatctcatttcaaagccttaattatatctttgatgactctttttccaaataaggtctcaattagaggttcctggaataagacacggactcatctccctgggggccaccattcagcctgatccggaaggaaggccatgatttcagctctctgggatttgagacaaagaggccccttttctttcattttatcttttcatgtctcttcttgccatgtacccacatgattgagtgtgggctgagggtgaatccaagaagggctttgttttgtggtcagtacaggctttggtccacagagacaacaatactttcaatactcttttgttctgccccagaggagctcaacacagaattgcctagaacaagaaactgggtaagtgtgcttggaacatacgcttgtcttctcttctttggactcttgattgcaacactcatctctgcctggatattcacatggacttatactctctgtcttttcttctgtgtgtcttctcttctgtatgtcactgaatgttgggcccacctggataacccaagatgatctcatcttgaggtacttaattatatctgcaaataacattttcctaaataaggtcacaggcatagttttgggggactgggacatggatatatctttttggagaccatgatttaactcactataggctaaattctcagccctaaaaggggtcctacacaaagtgagggcactcaatggaaagaagggctctgagatgtgagataggaacatgtgaacagaaccttcaacccacagattcccctggactatcaggtccaggagaagagactccttcctctctcaggttgagactcccacggcctggagattaggcaaagcctctgttcgatctttgcatgaaattaagtagtcttagtggtctattgcaggggtctctatctgtgattgacctttacttatttcttgcttaatgtactatcattctctttttttcttgaataaggtagtttacatattaaattcttcgctaaagatacagctcttaaattaaaaaatactactactactaccattttgctttagtcagtaagttctgccttaattttctgtctattttatatattttgtctatattttgttgatatattaaagttttttcttgtttttattaatatgatgatttaaggctctagaatttcttctgagtgcagatctacctgggtcatacagatgttgtcatatgtggtcagttcttttacaaatattcttcaacgtttttctctttggcccttaatgatataagaaaacttccaaaaactgtatgttttttagtgttttggagttttattgtttatttaatttcactgcatcttaatcaaataattaaaaatgctttttagaaattactgaagttttgtggtctgaaatatagtcttttttatgatctgtggaatcaaaaaaaaaagcattctatatttttaaggtgccaagtttgttatctgtcaattagagaaaactatgtgatttacatttttacatcatgacttactattgctctcttcagcagtcacagcctgatagaggtgatgtaattttccctgctgtgctcctgtgtctgtgtctttccttatgcatgctctacttttttttttttttttttttttttttttgagacggaatcttgctgtgtcgcgcaggctggagtgcagtggcgcgatcctggctcactgcgagctctgcctcccaggttcatgccatttcctgcctcagcctccggagtagctgggactacaggcgcccgccaccatgcctggctaattttttttatttttagtagagacgggctttcaccatgttagccagcatggtcttgatctcctgatctcgtgatccgcccacctcggcctcccaaagttctgggattacaggcgtgagccaccgcgcccggcctactttttgttttaagaacattgatgctctgttatttaatctctagaattcataactggcatatcttcattgtgaatcacacgcttattttttcttttctgctactttttcttacttctatgctttttctgccctgtgttttaaagagaagaaaatcagtgatgccacacaaaacactccgtggtagtcagatcacagcgatggttttaacatttgtagtgctgacattctgttcccgttcttgtctctttcactgagttctcctaccatcaggcaggttccatgctcgtcaccaggccctggctgcaacttttcataccctatcaacatttggttcactgatgattgttgtttgctagattttccaagcagttccatataaacaatgttcccatatctttgaacattcaaaaatcagtttgtattgcgtttatacttgattgaaataatagttggtataaaatttccgggttgcactttcttggtgcaaaatttcacaggtctcagctctttcagtattgaatactgctacacactgcccttgtgattacagattcaagctggccatcagacttgcaagacacagacagctttaatctgatgctacatttactgggctttaaaggaggatacaggccgggagacacagctggtgtcctggggcacccacagctccctttgccctttcacctatccagggcctatgtggctgccacaaacaagagtcagggtgcttgcgggccacatggataatcagaagccaccgccttgatttcccaacaattttttatgctatttctagacacaaagctacaagccacatattgattcacagcccccctgttccaagggcaatggaacataggtgatgagggagacattccacatctatttcaaatctgtaatttccaagtgtgtctgttagcttctgttgattaggaaattatccccaaatttagtcacttcaaacagcaacagtttgttaacctaaggatctgctgaagagttcccatggtctgggctggctctggctaatctcgcccaggcttgctcacatgactgcagtgccttagcaggatggcagagggcgactagcccgtcatagcctgcctgtggtctggtggttggccatttgcctctggctcagcgtggcgattgtttcattattttgcattcttttgttgttgttgttttttgttgtttttttttgtttgttttttgtttttcgtgttttttttgagacagggtctctctctgtcacccagactggagtgcagtgacgtgatctcagcttacagcaacctctgcctctgaggctcaagcaactctcccgcctctgcctcccaggtagctgggattacaggcgagcgccaccaccgcccagctaatttttgtatttttagtagagatgggttttcaccatgttggcccgggtggtctcgaactcctgacctcaaatgatccagccgcctcgccctcccaaagtgctgggattacaggcgtgagccactgcgcctgcctgttgttaatagtggtaaaatatttggtgcagcttctcagtggccacattttacagtttcggatgcactttctggatcgggcatgcattttctgcttgtgtaactctgcttattttgcattattttaaggcatttataattaattctgattcctcattttggactatgttttgtttctcctgaaccgtctctttcctgtaggtagagggaagcatttcatggagggccaggtccctggctaggacaaggtagagcctcacagtcatatttggtatccagcggccattgctctgccccagcctgtcatctggctgtggtgggtttggtggcccacgtctaactctacctctgtttctagactgtgacccgggaccgggggaaattagtagcagcccgtgcctccagtgccactgtggcgagccctctaggacgggcctctcacattgggctttatggtgtccgcggcctcagtgtcagtactctgctcctccccacaagcagccctgctcagtttgccctgggctggcaggctttttctctgtgttgaggtttggcatttcacctcactcctgttttcattaaaagtagacttttcctttctatttcaagttctgtggatgattttgggagaatgttttctttatatcatctgcaaatacgcttcctcatttcccacctcgactttccatcttccactttcaatcttttctttttttggaaggagggtggggtattgtcagagttgtattttccaagagccctttcaatttctccatttttgccctttatcactgtgtgtgtgtgtgagagaaagagacatacagcatacatatagaaagatgtgcaaaatgtaaatgtatatttaacaagtggttataaagccatataatatgcaacaaccacacaggtaaagaaataaagtcttaccaaaacctagcagtctcccaggtgtccctctccagtcaccacactcttcctcatgcccctaccccagtacccccaggagtcaaacacttttctgcctttagtgtcatcatgtcttagctgtgtttataattttaccacctatatatgcattacgaaagagctgcttctccttgctatctttttcttgctgtaggtcttgtatcttcaaagatacttagaaatagggttccgaatataactttttctgtttctgcactctctctcttcttttgtgtttcctttaatctgtcagactgattttgttccactcacatgaaaactctgtccccagtgcctcctgatccttgcctctgcattcatgactaagtgtgatgcactgggagatgactgggagtccgtagggagtgggcgtattggccagtggtccttgcctctgcattcatgactaagtgtgatgcactgggagatgactgggagtccgtagggagtgggcgtattggccagtggtccttgtctctgcattcatgactaagtgtgatgcactgggagatgactgggagtccgtagggagtgggtgtattggccagtggtccttggctctgcattcatgactaagtgtgatgcactgggagatgactgggagtccgtagggagtgggtgtattggccagtggtccttggctctgcattcatgactaagtgtgatgcactgggagatgattgggagtccgtatgggatggcgtattggccagtggtccccttaacagagcggacctttgttgttgggcatcacctgaccccagtgtctaaaggagaatttcctccttggagataacgtctgaccgcagccttctgggagccacgggaacggtcttgtgtgcctgcaattagaacacacgtaatcactttatttctgaatttaagcctcacccagtcccccatggttgcttatttgctgactcctagctaggaaactttctgagattctctgagtgaatcacatttgttttcttcgtaggttgtggctttctttattgtactaaatcaatgcctactagtctgttaaatgtcaaagaaatattaaactttttatattctaatactactcccattcttttgtcctagtgggcttaaggatgttttaatttattttgctgtcctcgtagttgattttctttcttctttcttttttttttgagacagagtcttgctctgtcccccaggctggagtgcaatggtgcgatctcagctcactgcaacctccacctcctgggttcaagtgattctcccgcctcagcctcctgagcagctgggactacaggcacccgccaccatgcctggctaatttttgtatttttagtagagacggggtttcaccatcttggccgggctggtctcgaactcctgacctcaggtgatctgtccgcctcggcctcccaaagtgttgggattacaggcgtgagccaccacgcccggccttagttgattttcttaaggcagagcagataacatttgtgcttacactaccacatttaaccaacatttcaatcagggatagtttaaataaaactttatataagagtttcccatttcctccattctctttctagaagttttttttcttttttttttttagtattgttattacttgtaactgtctgtgtgagtgcagagatataatattaaaatttatcaaatttcagggtagtgatattaatcatttattttagtagcaaaattaaatgttaacattcaactgtaagattggaagatttaactgtcttttcccccattgaattaatacagaacaaaaatttatatttctgatacagacaggagacagggaaatactgggtagaagatgatggtgccctgacaaaggctctgccttcaagcctggaagcccatggctctaagtggcaacaggcattcctgttttcctgcccaaaagttgccttttcacctgccatgccccactatcctgtacccatataaaccccaatccccaggctccagaagcaggcaaggaagtaacaaacagaagagtagaagaatagcagaatggtgtggcagagagaagagaaggaacatctgaacatcgagaggagttcagctagggatggttggagaggagattggctgctggatggccaaactccaggggaagatcatcttcccactccatccaccttccagctccccatccatcccactgaaagccacctccaccactcaataaaacccccgcattcatccttcaagtctgtgtgaaatctgattcttcctggattctggacaaggacctgggtactgagagggcactgagctggttaacacttaagccatctgcaaacagcaaagctaaaagagtgcactgtaacacacgtccacttgggctttgggagttgcaggcacccacccttagatgctaccatggggccagagcccaaaacacactcagcctggctcctgcacctgcctgtgtgcccccctcccataaggggtttgagtgtgcagtggcagaacatacgagccacacccctgtcgcatgtcctgtgaggggggtcagggaactctaccgtttcatttccactggttgatatgagattttgcaaatgatacactgtagatcagatactctcaaagaaaaaaaaaggctacaaagttgtagtgttcaattaccttattcatgaatacttttttcctaacctaattaactcaatatcttggcatcactaggactttgagctttacccaatacgggtttctttcttcccgaagcgtttgttttactgccccattttattgctttcaattaatgaaatctgattctaaaaccaagagttcctgaggtgttagccaccaccactatcctccctgctgtcaccttcattctatctgttccacctatcttttgaggacatctagagttgaggttattaaccttatatcatgttcccttctccccccatttgtactcattttgtttagtgtgggtaattcaaatgtaaattgttttggtcacaaaccccaactgcttgctcacagaatagcctgcaatctgccttttgcaatgatcactccttcctggagggtacgttggcatcattgagtctgatggcacctgcttctgccatgttagaacactgcctgcagccctaggatctggacttcagtcagaccagcaacatattcgcttttttctcttctttgtttgcctatttctctgtcttctaattgttttaaaggtgaaggagagtagtagtacagaaataataataacacaaaattaaaattaaattaaaatgtaaaaaataagtacagaattaatttttctctggcttgattttaaaatgttagttccaagtgctttaggttggagatgtttccgacccgagcatgtcttcccccacgtaagcatcccttcacacattctttgaaatcagctgctctgatcctaaatgtaggcctcacgtctcaccagctgtataatcttgggaaagtaggaaactcactttacttctttatttctgggacagggatcctatctccaagagttgttgaaaggattaaatgatacagtgcacttaatgttcctggtagataagaagtgctctataagtagtgaccatttttatcatctgtgtagatgttaaagtttgccaggatattctaggattatatactctgcaattccgtgctgctttcatacgtttgctctgataaaacttccctaggacactgagaaaagatttttcagggctgactaagccctgcttaaatattttccagctgttctggttcttaagaaagaaaaaaaaaatagattcttaaaagagaattaactcatttattcttactctttattctctgtgtctgaggggagaccctaccaacctcccatctatgactcccagtaatcacaggatacatcattgtctgggaagagagggagagggccacaggcttggcaaagtccgaacttccggtcttcctgctttccaatatccccaggcttctggccttgtacacggttaacgtgtttcagctagtgctgagtgttgcattctgccccttcaaccagatcacttccgctgaaagtttgcatctcccagtatcagtgttggggaagccaaatgaaatctatcaatcccagttcagaatgtaaagaaactgaagatcctctttccccatatggattattatatcatcatagcatttggagaagccaagatcaacaaaaaagcagttagcaggtatgcatgtgtgtgtgctatttgaacattacacatagtaatttttcagaaaagattctcatctctgaaaaacttttcctccctcaagacaaaaagaagtatagctcatttcattttaggatataatctgtctttgggcttcagcattttaaaattagacatatctttgatagaatattctttcaattgttaatttctccaagaaagttcagctctctggaatcagattgagattttttgttaaatccttatatttgtcttcagtgcattcatgttttaaaacaatacattgaaaatttggaagtgtttttacttcaaataactacattgtctttttctaaaatgagaagttgcagtgttccatgttctgatttgatatttttcctgatttctgttagtagtcttggatgttttctgtacttgtatttggagtatgcacacttgtctgagacagttctatttctcacagtcttcactgtgccacatatttgcttccctgtcatcttcaaaagagtgggctaaggccaggcgcggtggctcacacctgtaatgctgacactttgggaggccgaggcgggtggatcacgaggtcaggagatggagaccatcctggctaacaaggcgaaatgctgtctttactaaaaatacaaaaaattagccgggcatggtggtgtgcatctgtagtcccagctacccgggaggctgaggcaggagaatcacttgaacccgggaggcgaaaagttgcagtgagccaagatcgcgccactgcactccagcctgggtaacagagcgagagactccatgaaaaaaaaagaatgggctagagcttggctacactgcgagatttattgtctttgaactgccacttattctgagctgctcacttccattaatcagcctgacttaccgactctggaattgtgtgctcatatcagacaggttgtggctaaagtccatccattacatttctaggccctcacttctctgtacaaccccagttcagtcatgctggcaaatatgtggggagcgctcagccctgaggagttccataagggaaagttccacatgggcttggattatatacctaataactcagagcaaatttgtgaaagcttcacatgtcatttacaatttgtaggcactgcagaactgtagattctaaagagagaaggctatgccttctgatgatagtcttaaatcatggaaagctaaaacaataaacacctcaaattcagtgtatctttgccttggaaaaagggttagacttcatggttgcaattcacctcactcgcctgtggttcattgattctgacatctaattaaattgatcatctacagtgatcacaaggcgattgtttgccaaacactactggcaaagaaaacttagctcatacttgtaatttactttaaggtttctatccggaattgggaacaaataagaaattggttttgactaggaaattgtacacaattgtaatcataatttggactggaataataaccactgtgcatttgcttgtttctgactttgttagtcttcataatattcctttcaggaggttggctatatttatagttaactgaattttgccaatgttttctttccacaaagcttgttgtatttaattgtctttaagaaaagaaacgaaaagtatctgtcaactttcaagaaataaaatgtttttgttaaaaatcaatatttattaaagcgaatgtcttttgaaaattcaagcaatatataatttgcaaacatttgattaaaatagtttcagtaatatatttttagcttgaatgggtcaagataataaatcaatattttctctcaaattctgataacgtgtaaaaaagttctttgaaacaataataaaacttaagaaaaagcagtcagtaaagctactgatgattctttatttccttttatgagataatcagtcttttgacttcagcattttaaaattaaaaatacctttgatagaatattcctttcactgttaatttctccaagaaagttctgctctttggaattagattaactaatgatattttttgttaaatccttatatttgtcttcagtacatcctagtagacttgtttagatagcagacccaagagttaaattcaaataattagcaggaatggaaaatagaggattctaatttttcttaagaaaatgctttcttatcattggcaaaagaatgagtttattcacagacatttttattccattattctgtgagtaaagaaaggaagaggaggcatgttgaggttttcttttcctaatgatgttacattaattattgtagccaagatacgcttttgaatacgatacaaaaacatacctacaataatgatcataaaaatattcctttttccatcgctgaaaattgcctttatttgacaggatgatcttctatgcatctcatccgactgtctgtatttcccttctgctttggtggagtggggtgagagagagagagagagagagagagagagagggagggagggagggagggagagggagagagagacaaggcggaagcagagcctttgcgggtagagcagataaagattcccagacaaatttcatgggtgaagtggccaatttacttcttttatagctgaatgtcattttttttgtggatttttccatcaagtagtgaaaactcacatattaataatattcagagtctcctctggccatttaagcaccctctttgtccagagtcaagtcagattcttggcggccctcctggcgccacgtgtgtgaggtggggggaggtttctcacccttggcgatcctctcctccgcacaggggcgtctgtgggggtgtccgccattttgtttggtctcagctgccagttcccagaggaaccctctcttctggccacacgcccgcttgatggtcacaggcctccgtcagcggcttctccatccctctctggcaagctgaagtacgtgacgacttccctggccctctagggttctcaggccgtcaggtacgggtctctgtcaatctggcacctgacagctgagacaaacgaaaaagacgctccgctcgctgattcctgggccgcgcggggtcacggggcgctgcggctttcctggaatctcctcaggattcaggcacaccctgtgctctcaggttcactaaacccgtctggggtttctacacacgacctgaaggcatctccgccctttggcggcagatagaggaatagaaacgactgaggagacatgaagcagggaggaaaagctggatgagaggaagcacagggagtggaaggcaacgtccaggagacacggctcctgatgccctttcgtctcggtgggctctctgtggcgaaccgttgtctgcttgagaggaaaagggaagtcatatttggtgccatcctctggactccagatgtttttgtgcctggccataattatatatatatgcgcatatatatatatatttgcatatatatatatttgcatatatatatatattttgtttgtttgtttgtttttggagacagaatctcactctgtgcccaggctggagtgaagtggcgcgatctgggctcactgcaagccccgccttccggcttcccgccattctcctgcctcagcctcgcgagtagctgggacgacaggcgccgccaccaggcttagctgtcaaattagctatttttaaggtaatcgattctgaaaggcaagtcagaatgtataaagctcaaatgaacttctctatgttacacactgtttctgtaccattcagtcttgactccactcttcctgccgccctcagtctagttgcagtccaggtgccctgttttcagttcctaaaccacaccatgtcatctctagcatcaagcatttttctctacagcatttttccttcctacctacaacccatactttatatagttaacttctattcctcatttttatcttcatttcgagtaacagacttgggaaaatcttccataaattcgtaagtttaagtggagaagcccttatgtgtgtgtccacagtatcccatagcgcttggtactgtgttaccataacacacaccactgccttgtcattgtctatttaccaccagactaagtccaagaggcttcttttttgttttgttttgttttgtgtttgtttgtttgagatggagtcttacactgtcgcctgggctggagtgcaatagcgtgaccttggctcactgcaacctccacctcctgagttcacgcgattctcctacctcagcctcccgagtagctgggattacaggtgcgcattaccacgcccggctaattttttgtatttttagtagagatggggtttcactatgttggccagactggtctcaaactcctgaccttgtgatccgcccacctcagcctcctaaagtgctgggattacaggtgtgagccaccgcgcccagccccaagaggcttcttgtaggtcttgtctgttgttctattctagtgccttgcacagtgcttgaaatatggaagaatctgtaaaaaatcatattgagtacagttggctctctggatccgtgggctccacatccttggattcaaccaactgtagattgaaaatattcaaaaattaaaaaaaaatcgcatctgtactgagcaggtacagacttttttcttgtcattattccttaaacgaaaccgtataacaactattcacatagcatttacattgtattaggtattctaagtaatctagagatgattaaagaaaaagcgaggatgtgtgtagcttatatgaaatagtgtgccttgttatatcagggacttgagcatctgtagattttggtgtctttgggggtcctagagccactcccctgcggatacggagggatgagtgtatggaggtggtaaatgacttgctccaggtcacattagtgagtgaaagagcaagggatgtgctctcggccattcagttctagaatctgtgcatttaaccacgatgcatatagccagacacagagctgttattccaaaacactgagaattagtaacaagggctctttaaactattggatctaaactaatttcaactagattaaatctacttcattactttttacaaatgttgtttcctgggtggggccttttggaatgatgaagttaattatgaaataaaaatggaaaaatgaatttcatccaaaatacattttctgcagatttaaatgtctgtgtatattacatatacacgcatctgtatctatgcatgtctttacatagatatatccataaatgtatatgttatatacagcgtattagggatagttctccagagacagaacacacgcacatatatacacacacacacacccacaccctggcgcacacacacacatccacacacacatatatgtgcacacatacacacacacacacacaccccgccaagcacctcgtaacaatgtttaacagaagaccacatagacaatggtggtaccatgacatgagattctagtggagctggaaaattcctattgcctggtgatgctgtggccagaataaagtcatagtgcagcgcattactcacatgtttgtggtgatgctggtgtaaacaaatcgtgctgccggtcatataaaagtatagcacagcccaggcacggtggttcatgccagtaatcccagccctttgggaggccgaggttagtggatcacctgaggtcaggagtttgagactagcctggccaacataatgaaaccccgtctctactaaaaatacaaaaattcgccgggcatggtggtgcgtgcctatagtcccagctactctggaggctgcagcaggagaattgcttgaacccaggaggcggaggttgcaatgagccaagatcgtgccattgtactccagcttgggcaatagagctagactccatctgaaaaaaaaaaaatatagcacatgtaattatgtacagtacatatttgacaataataataaatgactgttacctgtttatgtgtttactatatcgtatgttttatcattatggtagagtgtatttctacttacaaaaacagtgaactgtaaagcagcctcaggtacctccttaaggagctcttccagaaggcattgctatcacaggagatgacagcttcatgtgtgtttggcccctgaagcccttcccgtgggacaagatggaggtggaagacagtgatattcatgatgctgacccccgtgtaggcctaggctaatgtgtgtttgtgtattagtttaaaaaactaaaaattaataaacatagaggaaaacttatagagatataaagaaaatatttttctgcagctgtacaatatgcctatgtttcaagctaagtgttattacaaaatagtcaaaaggttaaaacagtcaaaaggttaaaattaaaagtttatgaagtgaaaatgttacatcagccaactttaatttattaaggaaggaagagcgtttcttttttaatgatgtagtgtagcctctaagtagttttcatgaagtttgcagttgttacccagaccttcataggcgctcactactcactcagtgacttacccagagtagcttccagtccttcaagctctattcatgtgaagtgaactacacaggtataccagtttttatattttataccataattttaccgtcccttttctatgtttgggtacacaaataccattgtgtttccgttgcctgcagtattcagcacagtaacctcctgtacaagtttgcagcctagaacaataggctctactgtctagtccaggtgtgtaggaggctgtgccaactagatgtgtgtaaatgcactctagaatgttcacacaaaggcaaaattgcctaacaacgcatttctcagaatgtatccccccttgttaagtgacacatgactccatgtatatatacaaagagagacatagagagagagagagcgtgcacacacaagaatgacagggagagagagatttattataggattattatgggaattggctcccataattctaaagactgagaagtcccatgatctgctgaagaactaggaaagccgatggtataattaggtctgagtccaaaggcccacaaattaggaccaccacactagctggctgtggtgtcagtatctgtcatcccaccgatttggggggctgaagtgggaggatcacttgagccaggagtttgagaccagcctgagcaacatagagagaccccagctctaaaacagaaaaaagaaaatcaggagcaccagtgctccagggcaggagaagatggatgtcctaggtcaaacagagagaaaattctccctttctctgtgtttttgctctatttgggccctcagtggattggatgggagtgcccagctgcttagtgaaggtgatttcctttactcggtatactaagtcaaatgctaatcttttctgggaacacattcacagacacacgcaaaaagtatgatttcccagttttctaggcatcctttagcccagttaagtgggcacgtaaagctaaacatcatatacatgtatgtatgaatatatacatgttccttaccctggatttctctttccctgtcactcttataatttgtgtatttatttggggaaagaatagttatcaagaatttctagaggaagccaactgtctacataagcttcagagttacaacgcctaactctatccaatctaagttaaatttaagaatgaatgttgagtacatctggtttgtatatggtgttttggcagagctcaatttaattcatctcaaaaagcatccagtgagcacataccaaataatggcctcatttcaggctttgggctgtataaataacatacatcccaatgtggggaaaccagacaataaacacaataatttacagagaatttaaaggaggatgagtgtcatgagaagaaaatagtaaaaggtaaggaggagaggaactacatcgtttgggattgcaattttaaacagagtcaaaacttgaaataattttagtatgttgcaaatatatctaaaatacgtaggacgtcttgcatggtcacgtaagtctagaattcgaaaaatagctagagaataaactgaaaattcaaaattaatatattagaaaaattttggaacttttatattatagcaaggtaattaaaatattttcataaatgtacctttattttgttatcaggaattaggcaaaggctgttgaaatattcgcaaatacaacccagctctagaaatcaggaagtggtgctctacggatatgcaggagggagtgctgaaagaacagctcatgaggtagtgcaggcagaggcaggttgatggcagcagtgactccaatttgctctcactctgtgtctccattcactttggtagtgcaggcagaggcaggttgatggcagcagtgactccaatttgctctcactctctgccttcattcactttggtagtgtcctcttacacagacgctgggattggaaaccagattgctttgacaaatgggaaattagcaaatatgagatgtgcagcaacttgagaagtgctcatgtgctgaggcatgtttattgatacacttagagacccgagaccactatgcaaatatgcgcccaccagccctctggaggatgagatgattgcctccaacaactgagccaagcatggttttatttttgtttttgtttccgttttggttttcagatggagtctcacttttttgcccaggctggagtgcagtggtgtgatcgcagctcaatgcaacctctgcttcccaggttcaagcaattcttctgtctcagcctcctgagtagctgggactacaggagtgtgccaccatgcccggctaatttttgtatttttagtagagatggggtttcaccatgttagtcaggctggtctcgaactcctgacctcaggtgatccactcacttcgtcctcccaaagtgctgggattacaagcgtgagccactgcgcccaaccctgagccaaccatggtttaaccaccagtgatctgagtggccaggtggtctctgatgatccacaagctgaccaaggttatcacagatgctcacataagtctagcccagaccagaacttccaagcagagtgcagctgaaattgctttcatagaatgagctaataaatggtcgtcatgttaaaccagtaaggttaagtggtttgttacacagcaaaagctaactgacacagtgcatttaactacttcaattctgatagcccatcacagaatattttagctaagaactacatctaatttatagtcctttatatttttttctgttggaagcatttcatagagacaaactagttgctatttaagtaaaataatgcaccattatgcatacgtttttgttacctatgtagacaatgagaaaatagaattgttttaaattcctagggacacttataagttctaggttgacatttatcaaattttcattattatgtctaagcacagtctttccctactacctcccaaataaagagttacctgctaggcgcacatctatcccacgaatttgtcagctcaaaggaacaaggccagcagttatgcttgattatacagaataaatagagtatgaaaattgaaattagacacacttactataaaatgtgatgattatttccattccaggaccaaattgaattaaaaaaaacttattgatctggattgaatttcaatttgctaagatttgagcaagccaacttctgcccagtaatgtttgaatagaaaggcttatgaggccaatagtctgttcatcacaggtgataaagtttttttttaaagtcaataaattactttttactacaggagaaacgtatgctttatatgccaacaaagagttgaaatgccagaagcacttgaggactaaattacggagcacttatttcatcacaacagaacgctaacgcgggtgcttgattacaacaagccatccaattgcatgaatttgggctgcaaggcacccaggcttttatattcattagcaaagttattgattctggaaagttacctctaataaaactacaccattttctcaggcctgttatatgggcgcagacaaattatttgatcaacgatattgagcaaaaggaaaagcattcattgtctctaatctcttttccctcctcccagaattgtacatggcgatcatcagcagtatgaagaggagctgtggggccaggtctgatttggttttatatagctatataaatatttgataattaaatcacattgtttcaataagaatattaaataaaagctaaagttaaaaatgacaaaataggccgggtgtgttggcttacgcctgtaatcccagcactttgggaggccgagatgggtggatcacttgaggtcaggagtttgagaccagcctgaccaatatggtgagaccccatctctactaaaaaatacaaaagttattcgggcatggtggcaggcatctgtaatcctggctacttgggaggctgaggcaggagaatcacttgaacccaggaggttgaggttgtagtgagcctagactgcaccattgcacttcagcctggtcaataaaagcaaaactccatctcaaaaaaaatgacaaaatagtataatattatattcataaaaataattttacatttacacaaaggtgtaattcactgtacattagcttcaacaaaacatccataagttattcaattcccagttatcggctgcttgaacttttatgccctttagctccatctgttaaagaacgcatacctccatagagctcccataaaatagtttttaattaatttaatcaaagaatattgttccaagaatatagttaatacactgaatggaatttttataaataaaattaataaagatggaaatgtgttacttaaaaaataagattctagctattctatcattgtttgtgtttccatttaaatattagaatcaccttgccaaattccacacaaaaatcctgctgatattttgattggaattgcattgaatctattgcattaatttggggaaaattaatatttaaaaatagtgagttttccaatccaatcacaaagtataccttaccatttattagaaatttaattttctcagcaatgttttagttttcagtgtggacattttccacctattttcttaaatttatctctaaatatgacatattctttatgttcttatataaatatttaaagttcacattcataagaaaattcaaaccaccaactgggagacattatttgtaaaatatatgtctgacaaagaacttgtatccaaaaggtataaataatttttgcaattaaataataacaatataaagaaaaattgcaaatatggaaaagattgagatacatttgaaaatagaaaatacatgacccacaagcagattaaaagctgctcaacaccatcagttatcaggaaaatgcaaattaaaatcacagcaatttatccattcacacactaaaatgattacaatttaaaacccaatagtaataagatttggcaaaaatatggggcaacaaaacttctcatatactgctgaacagctttataaaacggtgcgaccacttaggagaattgtttggcagtttcttaggcttagatatttgtgccaaagaattgaaacctggttcacaaaaatacttgcctagaaatggtcacagcagcttgattcatcatagccccagaagagagacaacccaaatgtccatcacatcacagacatgggaaaatgaatcaacaacatagatctcatgttagtctcttctaagtggacaggtttttattttccaatccagtaagacaaattctctagaaaacggcatagtacccacctcacaagttcactgtgagcattaaatgaattggtttatttaacacatgtcaaacattgtctggaaaattcagagcactatatattcagagcactatgtatatgagtcttggttatgagtattactgaaacttctatgtgccttgcttttcctgtatttcttgtcacctcattccccttcctcatggctccttttgaagatagtatttaatttacatctccattactgtttggaagctatgtcctttgttatactattttaatagtcacccttaaaatttgaatgtgtgtataaaacgtaagtcctaaagttaatcagtgtctttactttcttcaccctcagattcaaggacctaagaatgatttatttctcatcattcctttcaaatcacacttgcagttgtatttttaaaatttctgccttgcttttataacccacaaattagacattgtttgatattaacaaaagcaagagtcagatctcctctgtgttccttgtctcccttccttgatacatttcagaccttccttatgggaccttattctttgtttgtttttgaagcccaaccttagaagctgttttatgaggcttatttagaagtaaactctttcaaaatctgctcatttgtctttattttgtcctcattctcgaaagatactttagccgtataaactattctccattgcccattattttctctgaacacattgagggcgtttcactgtgttcttgctttgctcattgtttttgtggctcagctagctgtcagtctgaatgttccttcgtaggatgtgcgcttgtttcttctagatccctttgagcactgtagacgcaggtcctctttatagtacaattttggcttgtgtattgaggttcgcataaacagtatgggcttaggttcccaaccatggcagcccagtgggtaccacattaacaggggtgaagtttttactttttctccatctttatgaaaattgagacaggagttaggtagattgtttttccattctcaggggtctggctttatgcagatggtctcaggtttgaactctaggccacaggacactgggtgtggtcccagggagtctggtggcttcaatgctagctttcctccctgtgctgtgctcctgcctaggtcctgcccacatggacttccttcaccttcatgcaggctcatccatgctttacacgttatgcatgcccatttgtgtgtcccaacttagcattttgatttgttatatgaataaaaatcaagagagatgcaagatccgtagtcagtcatatttgtggaaatcgaaatcccccacacattttttcatccatttgaatttattaagtttgaggaaaatgtcttaacaaataagcaagtttggctagtcctagaaactatatctctaacttctaacttgggagttactgtaccaattatatggtgaaaaaaattatagttcataattatttggtattaaaagagacctaaaaattattttttattcattccttttacatctatgaggcaaaatgacaatgcaaaattatataaatgtgattatctacccgcaaaatttggattaaagactattttcatgtgaaaaatgtgaaaaagataaaacgtcacacagactgtgagaaaaaatgtactgttttcacatgttcttgtaaatatattcttatcctttttatctaacgtgtagctaaatatcaaagggccattgactatatatatatatatagctgatgctgaaaaaggctgttgaattgtttcaattaacaatatagcaaaaatactaaagcctttcacttttttttttttttttttgagacagtctcactctgtcgcccaggctggagtgcagtggcccgatctcagctcagtgcaacctctgcctcccgggttcacgccattctcctgcctcagcctccaaagtagctgggattataggcacacaccaccatgcccagctaatttttgtgttttttgtagagatggggtttcaccatgatggccaggatggtctcaatctcctgacctcatgatccgcctgcctaggcctcccaaagtgctgggattacaggcgtgagccactgtgcccagccctttcacattttatatcttgtaattctctattctgctctacaccatagggatgatccttccaaaagcatcctatctagattctgctgttaaatcacctttgttggcctggccagttatcaaactcaacagccccttcatcatcaaagactcgccctctatccgcatctcattccttgcttccgccaataatctgactagtaaagaagtcactgcatgccacaaattgtcagtgctgacttcctcaacaaggaagttatttatttacttatttaatatatgagtgactcagatgcaaattccatcttgagaataccaactcctgatgccaactgattgtcagtcatggctacaacaggagactggattcactcaaatagttcaaataaacagaacgtaatagagggactacttacagaagtgaagcagggttgaggaaagacacaggggatgttgagctactcagagctgcagtgacagcatgtggaaatagaattactgaagttccataaggctggaattgtgagagtctatccaggagtagctgaatttgcagaggaatgcagctgtccacagaaaaacaatggcaaaggagcaatgcagcagagaagacatagtctaatttctctttactttctactgtatgatatggtagaaggcttgcttttggctgtgctggaaaacatacagaaaggaaaaccaaaagataagctttatgttttaaaatctccactcaagatgcaggtggaaaattagaaagccactgtggtgatgttaaaatatatcttgtatgtctgaagtcagctacacaaaggagaaaacatcaaaactaattgcattgattgtgtagtttcagtacctgttaaatgcataattccatcgattcagtttggcaatggctgagcaactaactgactgtaaaggaaaaggaccctaagatttagtatggcaaaccgagataaagttaagaaattctagcccaccaatctcctgaaagctctttgtagccagaatcacctctgcctaagttgctcttggcttgaagatctgctctgagaagagataccatgtacgtcaatggaactacaaaatcttgaaaacttatgcgagaaggaagctggaaagcataaaaaaaattaattcttataaactttttttttctgccttctcttccctctctagctataattttggatttgtctatttttattttcatttatatcaaatgttgtctcatatattttgaagctgttatgtgatgcttgcatttaggattcttgtgtcctcttgatgcattaacaccattataaaatggctttctgtaccctggcatccctctttttcctgatttaatatgcccacagtagatttcttattattagaacttatgtagtacatttttgttcttcctgttacttttaaagtgaatttcttttagatggaatgttgttgtgtctatgaaaaaacagtctatgttttaaaatttagtatttagactatttacctttaatgtaattatgggcatagtagggtttaaatctaccatcttgctattcattttctatttgttccatatttttcttatttcttttgggtttccacctttttccatgttaattgaatattatttaatgtttgcacactatggccttattagctacagctctttattttattttatagatgttgtttatgggtttacaatctttaactcataacaatatactttcaaataatattttaccactttgcatataagaccgttaaacagtgtactttctgtctcctgtccatttttaatttatcacaatgtaccttcaaatcatattatccattttgaaaataatataagaaacttaaaacagtatgtgtccatttttctcttttttggagaattaccatgcattttatttctgcatatgttataaatttcacattacattttcttcttgttttaaactgttaattttattctaaataatttttttaaatgagaaaaaaaattgaatttacccccaaggtagcattcttgtgttctatcttttttgcatattttaaatccaagtatctatttgatattattttcttttattataaataacttatttctgcatttattgtagtgtaagtctgctgttgacaaattaccccagctttttttttctaaaaagtttatccttatttttgaatgatggttttgctgtttgctgaatttacagttctaggttgacagtttttaaatttttaaagtaaaattctaacaccttgtttttgcttcatttctgataagcttcagtcattctcatttttgttcccctgtgtgtagtatgtattttttctccagttgttttaaagttttttcttcatcactagtttacagtagtttcatttttatatagcttgtggtgcttctctttgtggtttgtcctgattttagtcagctgattggtgagtgtatagctttcattaaaccagtaaaatgtttagctattttaagtattttcctacctccttcctccccatcctgctcttgctttctcttggactctacttgcatgtatgttagattgctggctgtttttctactgttcactgattttgtatcttatttttagtctttttttctcaccttgcttcagtttggatagtttctgttgcaatattttcaagtatgtccatctttcctttcacagttttgagtatgctcttaaatgcagtgaatttttcaatttaaatattgtattctgggccaggtgcggtggctaatgcctgtaatcccagcactttgggaggctgaggagggcggatcacctgaggtcgggagttagagaccagcctgaccaacatggagaaaccctgtctctactaaaaatacaaaatgagtggtggcacatgcctgtaatcccagctactcgggaggctgaggcaggagaatcactagaacccaggaggcagaggttgcagtgagccacaattgagccattgcactccagcctgggcaacaagagcgaaattctgtcccccgccgaagaaaaattgtattctttagtcccaactattgatacatggataaggtgtaccatcgccaccaccattatcaacatcataacaacagtgttttatagcacttttaagactataaatgcttttatatatattaacagattttacactcactgaggcttggttatttccatcttaaagatatgaagtgtgaggctcagaaaataagtcagttttacaaacatactgggaaaaaaattgtatgctagaactgaaatctaaatctatccaagtcaatttttatttgctacttcatgctgcccatatctatagttgatcttttaccataccatgatcttaggagactaggaaacaataaaaccacaagtaagaaaatgattctttctatacgtttcaaaccaaatagctatctaagacaatttatccagataatccaagtcaaataaaagtatgcttcagttctctgaatattataagcaaaagtgtaaaagatagctttgtgcctccagtgaagagcagtcaggcaaccagaaggcatacctagcaatataatatttattatttcttgagcttttattgttcggtgttcaatagtcctgtgagatagttctcattattctttatttatacatgagaaaactgtctcacagaagttgcataacttgctcagagtcccatggataataagtggcccaggcagcacttgagtccaggtcagtcttgctttttccctttcttattcactgtcctaccttgcctctatgtttgtgtcccttcttagtcacttctcttgcactgttgatttgcctttttttaatacatatgtgctttatttactgcaattgacaaataattgtatcatttatggcattcaacacagtgtgtggtttttccttttttttttttttattttgagacagagtcttgctctgtcaatgaggctggagtgcagtggcatgatctccgctcactgcagcctctgcttgctgggcttaagcgattctcctgtctcaaccttccaagtagctggggccatccaggcatgcaccaccgtgcctgaattatttatttatttgtagagccctcttatagaagtctccctatatttcccaggctggtctcaaactcctgggctcagcaatcctcctgccttggcctcccaaaagccctgggattacagatgtgaaccgctgcacctggcctaacatgaggttttgaaatacatatatattgtgaaatggataaatctagctaaacacatacttatttttttatctgtggtgagaccacttaaagcctactctttcagcaattttaaagtatatcaccatggggtacaatagatctcttagacctgtccctactgtctagatggcattttgcatcctttgaccaacatgctgatttatctttaacatattgtattgctaccttgtggtaggcagaactttggtcgtcgtgatctcagccacctagcgttacatcctgttatgttacatggcaaacaggctttgcagatgtaattaatgttactcctcagttgactttaagatagggagattaacctagattatgcaggtgagctggatctaatctcatgagctctttaaacgtcggaagaggagggtagaagagaaaatcagagattataagtgaaaaggttggagatgtcattactggcatttaagataaagggggccaaaagccacagaatatgggtgccttcaaaagctgagccaatagctggcaaaatcatgagaacactcactcctgtagcaacatggagctgaattctgccaacaatctaaatgagcctggaagcaggttctccctcagaggctccaaagaagagcccaggccagctgacagcttgacttgcaccttgtgtgcccctatatagagaacccagtcaagccatgctgtactcagacttccaactcatggaacctatgagataataaataggtgttgtgttaatttattatggcagcaatagcaggctaatacatactttaggaacaattaatttcaaatttttgtgtgtgaactctcctcattcactatcatgacacacaaacacattcacccacacactctcagagatactcaagttgtatacttccagaagaggctttctctgtttttaaagtctgaagttctcagcattctcactgagccatgctatcacttttgtgtcactttggacagccttccctgcttctgtcatcctcaactttttcttgcattgtctgttttcccttttccctgtttgcacctcagttcttttgttttctgttaatattaggacctgattatatacacagctagtccacaaacacatgtatagttttcttcacaaaaaatcaaggaaggacattgcattgtgtgaagtgtttgcatctttatatttttattttatacttactgcaaagtggcatgtggatacttttctactgctggacacaaaggtatctattaagatagaaatattcctcatacacgtgctgtaggattcttggaactgaagaaaatttggcctctaaaaaactgtattatcataatcataagaattatatttgatagagtttctaatattttattaacatcaggagattcgattgaagtcaacatttgcaatttaaatgtggtattaagcactttgtttaaaggcagaataattataatgcatcaatgtgtatgtttctacaaatttgacaactataacacatgccacttaaaaccttatttaccatgcgcagtctcatataaatacaagctgtaagtctaagagccaccctagattccattctcttctttacctccagtgactagtccgtccccaaggtgagcttatttttcttcctgaatgaccctaaggggtaaaagtagatttgatagttggggacgatatgatttgtggttatacagaaaaacttttaactactgacactatacaaagctctaacttgtcctttggaggaaaatatttttcttactaacatttactgattagacatttagtgggaatatcaggcaacgtgctggtttcaaatggttggttgcaggtccctttcaaaaatgggcatttccaattctgcgtcaacatcattgtttacacagctgcagagagcacattcttccaggagcaccttcagggctttccgggaagcttctgggcttcgtttgtttggaatcctaaagcaagcagcctttcctgaaaagaatgtcctcaggaaatactttggaataaattaaatgatatttttaggcatttttatcgatctgttgtttagagacgattttgaatctgttgacttattttgtgataaacagaacttttacagcatctcaatggaatctgatttctagattgacttgccaccttgaaatgataattacattgtttttgagaagtaacatctttgtttccataacataagactttcagtttataacacaatgtacaattggggcttacttttttaaaagcactgatttatttgaaacctgtctaaatttggctaggtttcataattggagcaatcatcaatatagtatgaatgaccttatacaatataattttattaaataaaatatttttattaaaactaaatgaagtcataaaaatttgattttttttctaaagaaaaagtgtattgaaatccatggacctaaaatgtggcttattattaaaaaaatcctatttaaatatacttttgaaatagatacatgtttctagcatattttattcaccctgtacttactctcttatgagaattactccacagaaagtcatcttgttttatgaaaataactaagaaagtcattgtttttcttcctgacaacatttaaatgttggaagccacatctttattaagttacattcagctgattgcatttatgaaattaatctatgaggtcaaaaaagaatgaaattagtattcaaaagatatcactaataaaaatcattgatcaatttaaagaagttattaacatataacaatgttaagtagttcattatactttaaatatttccagtctattattagttaaaaagtaaatctgctagtatttcccccccaaattcattatttcaccgaattcctctcatctgaacatagcttagctgtattaagatgttgcgtaagacggctctcagaagctacttaatttattctaattaacaaatgtctgcattcttaatgtgttaattattagggctccccaatctcttattcgattttttcattcaacaagtatttattgaatgcttattatgtcaaaccctcttctaaatattggaataatagtaataaaacaaatcgaagtttatactctcaataagtttatgttgtaatgaaggatgcaaacagtatatacacactgcaatgtcagctagtgataacttttgagagaatagtgaaataacatacatacagggatagaaagtgatgggaaagccttgtctccaccgtccttctttccctctcagagctccagccaagtactttctccagcagtcgtgttaaacacactcccttctattattaggcatgtcctgacccctctatctgaaacacttgccctttgcctagctaactgctattcttcagtcacagtcaaatactgctccacaggcaagccttccccactcccagccatgctcccagagcatcatgaaacttccatgaaatttgacattgtttgtatgatgatttgttcactctattctcctcactagagcatgggattatatatatgtaatattactatatatatggcatagagtgaatgttcaatagaattagttgaacgcattattttaagtataatatatcaagaagacaggtttcaaagaccacatattttaaccattctgttcatacgggatgtttagaaaaggcaaatctatggaaaaagaaggtagattagtgtttatgttaccgaaacaccaggggttcggtcaaggtcctgctactcgctgcacagaaagccaatgattgagacgacgagtattgccaaggaagaatctttaatcaggtgctgcagctgaggagatggaaactcactctcaaatccacctccctgacctgctaaaaccaggagtttatataacagggaaaaaaaatgcaactgtgtgtaagaaaacaggaactagggagacgcaaggaagccatcacggtgaatgaggggtctggcatctcattgtctggatgtgatgatctggtgagtttcagttgtttgatacttttttttgagagacctgatggtcattttctgagggaggaactcagattaaacaaatataagtttcaagctttaagattagaagggtcaattcctatatttatcagaaaatatctatgagaccactgggtcagtttcatttacccagggctgagagagggaatggggattcactgctgactggcctgagggaacttactggaaagatggaaatgttctaaaactggattatggtgatggttgcagactaagcaagtttactaaaatcactgaatcatactaaaatcattgaattgaaaattagatgaattttatgatatgtaaattatatctcaataaaggtctttttattttttatttttctttttgagacagtgtcttgctctgttgcccaggctggagtgcagtggcatgatctcggcccactgcaacctctgcctccctggttcaagcaattctcctgcctccgcctcccaagtagctggtactacaggtgtgcgttactgcgcttggctaatttttgtatttttagtagagatgggattttaccatgttggccaagctggtcttgatctcctgtcctcaagtgatctgcccgccacagcctcccaaagtgctgagattacaggcgagagccaccacgcccagcctcaataaagttctttttttttaaaaaaaggtagtgactaggggaagtgtaaggatgtgggagtggccagggaaggtctttttaaggagatgctatttgaatagaaaattgacatgaaggcaagagccccaaagatgtctcgggacagagggctcctggcaggggagcagtggggatcttaggtgcattgctatgttggaagaacagtggggagtccaggtggctgtggcgaggtggaatgggggccacaggaggaagcggaggctagggaggagccagttaggtatgtgaggtttggttaattagggtcagggtattgaattttattttaaatgtgatgagatgctattgaaggattttagcaggagagcaacataatttggtttacattttgacagagtcactttggctgctgtacggaaaaacagaagcaggaagcccagataagaaattgagtagccagtcacgaaatggtggtgttatggatcagggtggaacggtggaggcggtgaaaagtatgtatcttatagatagaaatatgtgagaatatcacagcctattctaaaaactgctgaatcattgagtgcatatagttggagaagtgggtggagcagaacagcataagaagagagtaaagaagtgtgcagggtcagattacatgaggccttatagggcgtgggacagagtttcacttcatcttaaatgcagtgagaagtcattggaggatttcaggtgcggaatgatacagtcggactcactcacatgaagattattctgtctgccaggtggagaagagctcataggggaagaagcatagaaacccaagagcaagttaagacactaatggcagaggttaggcaagaggtggtggtggtgtagattgggacggtggcaatgcagatagaaaaataagcgtatacaagggctcctttagaattggaacagatgggataactggatatgaggaagaggaaactaaagagtgaagcatttttggtttgggtaactgagttacgcagtttttttttttgagatggagtctcactctgtcacccaggctggagtgcaacagcacaatctcagctcactgcaacctccacctcccaggttcaagcgattctcctgcctcagcctcccgagtagctgggactacaggcgtgcaccaccacacacagataatttttgtgtttttagtagagaccaggtttcaccatgttggccaggatggtctcgatctcttgacttcgtgatccacccgccctggcctcccaacgtgccaggattatgggcccgagccaccacacccagcccagttacagtagtttactccagaataatactacatgtataaacataggttacacacatacttaaaagaacattagagttcttttttgtttttctttgatgtttggctttgatttaatgggattttactatacacattactcttaagcaagcctttaacactcagcactttaaagtgcttggtacatagtaggcttaagtaatattttatcaaactgagctggagagttcttagatattgttcttatctcaaattcagtcatcccttggtatctgctagggattgcttccaggaaccccatgaatttttttaccaaaatccacagatgctcaagtcccttatacaaaacggtgtcttgtttgcatgtcactgacacacatactccgtgtacttaaaccatctctagactgcctataatacctaacgtgatgtaaatgctatggaaacagttgttttactgtatcgtttggggaataacatcaagtctgtacatttttcagtagagatgcaatgatcataggcctaactgccttttcaatctgcacgtggttgaacccatggatgcagagcccgtgggtgctgattgctaactgtatatcctacttctaatccttcttttgtatggagtgagcttccaaaaaccttctgaaacattaagtcatgctcttctttgaagtctgtgaatcctcagggctgtcggcgtgagaaccaaaggctgcagtggtgcacacaatgtccttcatcccagtaggttgattgttcagcatctgtgtgacccaacctctcctattgtccttgattcaatagctgatctactgaactatgtagctgaattacagctcctcaagcacagtgctgtcttggcttggaatgccctactgcttctgttattattatgatgacacattggtgatttttttcctatgagaatcttctctaatttcccaagtgtaagttagctatcctcctgtgtgtgccctgaaccctgtacatccccatcatcacagtagttcattgccttgtaattgcttgcttgcttttatgtttctcccattggacaatatattccttaaagccagagatttttccctgtgatattatcctcagaacttaatatagtatatgttgtcatactaaaagcttgatcaatacaacatacataagtaaaggaacattattcttctacattagagaatacagttcctagggaaagtatgtatttagaccacacgactgaagcaacaggtctggggaacacccatactcaaggaatggggaggaacaaaaggcattagaaaaaaaagaaatgggatagccgtgaaagcgcaagaacaatgttcagagtgtttatcacggccgtctggaaaaaacagaatttcaagaaatgaatgatcagtcatgtcaaatgcttataaaagtcaggaataatggctgtgaaatgtccaatcaacttggcaattaaaaatacactgatgactttatgaagcagtttcagtatgttggttgagacagaagccagatgatggggtgctgcataataaatggcacatcgcaggctgatgacagcacagccctgctttaatacggcaggaaacacgatgggttctgtggcatcctcctactcactgtcttctgtggattgtgactcctggtgactgacagatgtttaatttcctgagggcaagcaaagtcacggctttaatatgcccgagaataatgatggatgatgcaactttggataagcctgtagaagagacaagagaaaggaagaggtgtagaaaagctctgaaggggtctgggcgcagtggctcatgcatgtaatcctagcactttgggaggtcgaggcgggcagatagtgaggtcaggagttcgagaccagactgaccaacatggtgaaaccccatctctactaaaaatacaaaaattagctgggcgtggtggcgggcacctgcaatcccagctactcgggaggctgaggcaggagaatcacttgaacccgggaggcagaagttgccgtgagctgagatggtgccactgcactccagcctgggtgatagagcgagactctgtcaaaaaaaaaaaaaaaaaaaaaaaaaagaaagaaagaaagaaaaagaaaagaaaagaaaagaaaacagaaaagctctgaagggagaattcttgagtgtgtgatgtttgaaatactagactaaagggcagttcagtgggacagtgggtggaatttgcagtggataccagaacagagtttgggaagagagatttggccaagagactacaccctgcagatctccactgacagaggagttagtgaccaagagcctggccactgagctaaaatccatcgtgcacttgtgctgtaaccacattcccatgggctgctctccagccaatgactgaattggaagcagggatgcctgtcctgggagccatgagctcctctgatgcctgaggttgactcgtggacttccagtagctttgctgaaccttccatagactggaaagcagcctaagatgttttctcgcagacccctctggctccttcaccgttttccttttgcagtagttttcttaataacatccttgcatgtgtaatcctgtgcttatatcagcttctcagagggtccagaccgatataatatctaaagggtagttttatttttgaagggaggtgaattgctgtgttattagtgttgtacccttctatcattcgctatcattcatgtttctttaagatatattcggtaaaatacccatttctcactaatgctggttagagtaggtctttttttttttttttgagacgtaatctccctctgttgtccaggctggagtgcagtggcgccatctcggctcactgcaacttccgcctcctgggttcaagtgattctcctgcctcggcctcctaagtagctgggattacaggtgcccgccgccatgcccggctaatttcttttgtatttttagcagagcggggtttcatcatgttggccaggctggttttgaactcctggcctcaagtaatccgcctgccatggcctcccaaaatgctaggattataggcgtgagccactatgccgggccaggtcttctttcttgaggggagggacaaagtgaaataatgagaactgctctgcaatgtcttcttcagaagagaagctgcccatagaacagagtcccatgtagatgatacagtgatattaaatagaacgttccccacagaagtttaacgcgattagtatcaaggtgacgcttataaatgctaatgcaagaatgccattcaggagtcttgctttatacctaaaaaagcgatgtgttcctgattgtggaatatctttacaggtagaaggcaggtaatagttatatagaaataaaacaaaaataacaatgtataggatacagcctcaaagattcccagaatattagagctacaaggcacgttagagaccatctcctaattttaaatgctcttttgaatattctagtgagagaagctgcagcctgttgagactccacaagactgaagatatgaaaagaggaaatatgcatgaatgcccgcacggagaaccacccccacctgctgctcccgctctaatgatcacgcccattatcaactgggggatggctctgtgccttgtccttgcattacatggaccaagaacacttcacaggactcagagaggtaaatgagagaaacctattcttatagaggatgaaaatgaagcacacagggaggtaaagtgccccaaaatcccatctgaactggctttagaaaccgtatatttactttttcatataatttgtttatctaagggaaaaaaataacagatgtgtttaatggctttagaaacatttaaacaggtggacctcaaaatatgtgaaatgaacatattgccattgtttattataattttccttccttctatttttgcttaaaattcctcaaggcctttggatatgcaaaaaaaaatgagcatttgttttattatgttgcttaatagaaacaattttttaaagtattgatttacgcagtgaccaaaatactgattctaaacaacaaaacatgcagctgttacgaatcctggacgagctctggaaatgtgtggtattgtcttgcaaagaagctgtttttgttctagtcaaatatggaaactagtttagaaacttcattttaatatataattctgatttcagtgttaccagtaaatattaatgtccttttctaacagtcttaatttccttttctcaactcccttgagttatatattttattgaagcattcatttaccatcaagagaaaagaatgacataagcatgtgtgctgaaacgtgcggcttccaggccacagagttaaggaagctacatttgttctcccagccccttacttgtgctatgcatttagaaagaaaactttcgacgtctattgttcttacttttacaatttatgatgtagttaatcctattcaccttgtgtactgaggtaggtcagaatttcttctcacccttttcctcttctaacatgacctgttctttcgcatcatgagtcatagaaatgtaagctaatacataaagtttttgaaaagatgaggaaagagccagagaaataataatgccctgaggttgtgctataaggtatgttccacattggcaagaagtcccttgcttggtagatgtgttcctgtaagccctaaaagaaagggcaggtggctgtcatactccccttatcctccggacacaatcacctgagaccattcactaggccttccaaggggaagcccaggtgaaactgaaggacaacccttctgagatggacagaaaaagaaaaacgtgaaatcttatggtaagggtaaaaggccaaagagacttaggaactgtaaggtagggaggaaagaatgtgggagcccagagagacgggtcctctgtggccgtaacagtagactttcagtggagcgagagagaacatgaggaaactcaggatattctgcaccatggtttggactctaaaaatgtatttgatcatatgatgggtttatagtttttattcttggcctcggtctctgtttttttttcttcttatatgttgtagtgttgggattcactcagatggtggcagaaatattaaagggaaatactagggaaagttatagggaatagtcacaaaccttttggaaggctgaaagtttacatagcttgtaataattgaacaggctgaggcagccggttcttaccttagagcattaggtcttagggtaaatactagggacaacagaggcttccccacttaagtctgtttaccctacctccaataactaacctttgagccagatggcccacttgtggggaggttgactagggatattgtcccctaatggtatttaccttagaccttggtacctgagctttaatcattcctagaactactctcttaaccatgttaattatccacaagtgtgttgactcagagcttctgttgttaattgtataccaaataaatgcctggagtgcgagctgctcagggccagccacagtgacaaaccactcttggtgtgcaggcggtcggacactcagcaggactggcaaagcagaatatctgtgtcagtgtacgttttattcgcctgtcgtttgggtcagggtccatgggcagacccccgcagctaatgccctcaagggtgaggagcaatacctcattatagacttagttgtgaaaagtttttttaaaattaatgagacagtaatcaggtattttaaacaactgaattttacaaaccctcataacattgagtgggaaaaaaatttagatctcagtcaactccttgatcttacacataaagaaactgatgctcaaaatatgaaaagattttcccaagttaatattacacatgatcagtggatatgatactagagccagtctttgatctccaattccagttttcttactataataaggtggatttcttgtgagggaaccaaccggataaagtaaaaaacctacagtttctatgaggatccacatactttcctgacaatggagtaagagaaaatgtggcaagtgaccattgggccctccaggtgtcttagagtggttgacatagttcctgaacaagagtggaaatccagcctggcacggtggctcacgcctgtaatcccagcactttgggaggctgaggcgggcggatcacgaggtcaggagattgagaccatcctggctaacacggtgaaacaccatctctactgaaaatacaaaaaattagccgggcctggtggcgggcacctgtaatcccagttacactcgggaggctgaggcaggagaattgcttgaacccgggaggcagagcttgcaatgagccgagatagtgccactgcactccagcctgggcgacagagtgactctgtctcaaaaaaaaaagagtggaaatctaggtggattcagggatagggaatggtagcaaaaagagagagagaggagagagagggaagagtaaggagcacagaaatagaaagagcatctggtagtgagatgagctggaatctggggagagggacctgtgtccaggcaggcttcttacagagctgtctacttacagagctccacacccacagcgccaggtcagtgatttgtctgtcggtgcgcacccccattctgtgctcttttctgtatcacaggggactggatatctgcaagctacattttccacactgccttctgactggtatttaataagattttgataatgggaggcactggcaagaaatgggaaggtgggagaaagagcaaatccatatttttagtcattgtttttcctggtggtgcccttggcagcagtaaccacagtgacaagtggatgcaagcccgggttccctctaaggtggcacagttccaatggcagcagcagcagcagctgctctgacagctttgtaaccaccagtactcctgggccctggctcttgctgtatcaggagtgtgagctcctggcttcctgtgcagtggcagtggcagtgctcactgcatccggcagtggctaaagaaggactccagcctcctcagcccacagctgcgtggacttggggctacaccattgctctttggggttgtttttggctcatggggtggttgtggcatcctgaagttacgaacagcagttacgaacagcagttcctcaggtaccagtctttggggagcctcatccccttgttgttcctgcctggctttttgtgacgtttaaaaccaatgttcaaatccaatgtgtttggaatgcttagaattggttttgttttcctaactggacacgagagacacaagcactacgcgatccttctacgtcatgctcttaaaaaatatggcaaagttttacattattcatccatttctgctgttcccgtgaaactgacaatatacaaagaccagcgtgtgtggggccctggaatatgtcagtttatatttctattgtgtcagttttcttagggtatatggcgaatataaatatgactattataattaagtggctgtgcattttcatattagaattcattatgttgccttctcagtagaagcactttctatgtagtgcttgagcatataggtaagtcaggtggccacctgcacagtgtgatttgaaggtgtgaaggtatctctctgcctcaaatagcgattaaatttaacaggttcatattctgtagtgaaaaaaatacagttggccctccatatccacgggttctgcatccatggattcaaccaaccaaggataaaaatattttttaaaaattgcatctgcaagttaattataatataatgctcaagaaaattcacaacatgaatgaaatgttacagaagttataaatccattgcatttatcagtagctcatttttgaaaagggtctttggattatagatttccacttcttttacaaagaaacattgaagtgagaattttgtgggtactctttaaacaatagtacatgagtttaatacatattttttaaagccagtaaataacatttttctgtgtccactttaaagtgtgttgggtatataagtgaattggactgtatttctaatatgtgtgtaggtttaattttatatagtttttaaattgttctgtgattaatcggccattgaaaatgacctttttaattgttgagatttactgactagccttatatggaaggatttgtatatcctcaccatatatatatatgtatatatatataaatataaatataaatatatatggtgtatctatatggtgcatatatatagcgtgtgtgtatatatgtatttggtatatctatggtgcatatatttggtatatatatggtgtgtgtatatacacatatacataccatatatacacacacatatatataccatcttttatttgtgtggtgaaaaatactcttttttggtgtaaaaagtttattttctttgctaataatgtcagtttgtaaaaaaaagaattcatccttactgaatatctatagacctttttggtcagtattccctaaacaacgcagtataagaactatttacgtagcattcacattgtattaggtattataagtaatttaaggatgatttaaaatatacaaggggatgtgcataggttatatgcaaatactatgccattttatatcagggtcttgagcatccacggattttgatattagcaggaggtcctggaaccaattccacatggatacagagggacgtctctctctctctttgatattgttatattatatcatattatttatattatatatttatatattggtaatatttatatattagtttaaaggattgttataaaagtggattttaaaccacaacagcaaccaaaatgattatgtgatgttacagaggaatatggttgccatctttttttttttttttttttttgagacagagactcgctctgtcgcccaggctggagtgcggtggcacagtctcggctcactgcaagccccgcctcccaggttcacgccattctcctgcctcagcctcccgagtagctaggactacaggcgcccgccaccacgccggctaattttttatatttttagtagagatggggttttaccgtgttagccaggatggtctcgatctcctgacctcgtgatccgcccaccttggcatcccaaagtgctgggattacaggcgtgagccaccccgcccggcctatggttgctatctttaataaatattatggacataagagagagagagagaatgctgctaggtcacttaaaaatggagatgtgatttatgggaatgttcttgtctacatgtaatgcaacacgtggaatctttataataggtgtcaagaaatttcccattcaggagaattctgtaggtgaaggttcagagggagccatggctagatgctgggcaggggagggttagatgcagcctcactggaggggtcgttttctggaagtgatatctaacatccctccattatctggaagtgatatctaaaatccccaccattatctgaaagtgatatctaacatccacccattatctggaagtgaatatctaactttcccccattatctggaagtgatagctaacatccccccattatctggaagtgaatatctaacttccccccattatctggaagtgatagctaacatccccccattatctggaagtgatatctaacatccccccattatctggaagtgatagctaacatccccccattatccagaagtgaatatctaacatccccccattatctggaagtgttatctaacatcaccccattatctggaagtgatggctaacatctgcccattatctggaagtgatatctaacatccccccattatccggaagtgatatctaacatcccccattatctggaagtgttatctgacatcccccattatccggaagtgaatatctaacatctccccattatctggaagtgttatctaacatcccccccattatctggagtgatatctaacatccccccattatctggaagtgatatctaacatccccccattatctggaagtgatagctaacatccccccattatctggaagtgatagctaacatcccattatctggaagtgaatatctaacatcccccattatctggaagtgttatctaacgtcaccccattatctggaagtgatatctaacatccacccattatctggaagtgatatctaacatcccccccattatctggaagtgatagctaacatccccctattatctggaactgatagctaacatccccccattatctggaagtgatatctaatttccaccattagtgacactcctccatgtttcaaggtatgtatttcaagaaagcccttgttagaataacaggaatttattggggagaatagcacaatgtcttcttttttttgagacagagtttcgctctgtcgcccaggctccggtgcaatggcgtgatcttggctcactgcaacctctgcctcccgggttcaagcgattctcctgcctcagcctcctgagtagctgggactacaggcatgtgtcaccaaccctggctaattttgtatttttagtagagacgggggttctccatgttggtcaggctggtctcgaactcccaatctcaggtgatccgcctgcctcggccacccaaagtgctgggattacaggcgtgagccaccgcgcccggccacaatgtctttatcaatctacacgtaaggaattttctggtaaaatagtgctgggcagattgcaagtgggagcagtgacattgggtttgaacaacaaacttaaaagaaaagaaacaaagaaaagaacacataatctgtaggctgggtttctgtctgtctggttttgggatgcaaagagaagaaaaaatgaggtagtaggcatttagttattttctagcctaagattaaagtgctttttgctcctgcctaactttaggaaagtgaggaaacaacattcacagacaaaggacaattgagcatgagctccaggggaccatcagcaaaacattttcagaagatgtgaagagtaggatgcgtaagtcatggagcagatcagaggcctgtggataaggtaccaaggacaaggaagactctgtcggttgatgatcttgagcagtgctgctaggtcacttcaaaatggagacgtgatttatgggcatgttattgtctacatgtaatcaacacatggaatctttataatacgtatctatatttctatgaattaaagttttcctatggcctatagttaagtgttcttgcgaggtgtgtgagcaggtgcacctatgctgtacatgggggaggatgctagataaagaatattatctactctgtcttacagatcattcccagacggggtggtagaaacataccatacgaatgtaaggaggttcctaaaaatgttcacttgggccataagcaccatacaattgagcaaggttgcacatttatgaagctctacaaagcacaggttggtttagcattatctgctgagccattgggcaataccccgtgaggggcacagagagatgggacaaggcgcacagagggcatctggggagtcaggaaacagcatgaggacagggggcccctgggaatagaaggagacttgttcaagggaagaaactgaaaaacaaaacacaagggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagtatggggagacgatagggaaaatcagggtctctgtgtagttatctgtgtgactcagcatggggagacgatagggaaaatcagggtctctgtgtagttaatctgtgtgactcagcatggggagaccatagggaaaatcagggtctctgtgtagttaatctctgtgactcagcatggggagatgatagggaaaatcagggtctctgtgtagttatctgtgtgactcaccatggggagacgatagggaaaatcagggtctctgtgtagttatctgtgtgactcaacatggggagatgatagggaaaatcggggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgcagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctgtgtgactcagcatggggagatgatagggaaaatcagggtctctgtgtagttaatctgtgtgactcagcatggggagacgatagggaaaatcagggtctctgtgtagttaatctgtgtgactcagcatggggagacgatagggaaaatcagggtctctgtgtagttatctgtgtgactcagcatggggagacgatagggaaaatcagggtctctgtgtagttatctgtgtgactcagcatggggagatgatagggaaaatcagggtctctgtgtagttaatctctgtgactcagcatggggagacgatagggaaaatcagggtctctgtgtagttaatctctgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagatgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttaatctctgtgactcagcatggggagacgatagggaaaatcagggtctctgtgtagttatctgtgtgactcagcatggggagacgatagggaaaatcagggtctctgtgtagttatctgtgtgactcagcatggtgagacgatagggaaaatcagggtctctgtgtagttatctgtgtgactcagcatggggagacgatagggaaaatcagggtctctgtgtagttatctgtgtgactcagcatggggagacgatagggaaaatcagggtctctgtgtagttatctgtgtgactcagcatggggagacaatagggaaaatcagggtctctgtgtagttaatctgtgtgactcagcatggggagacgatagggaaaatcagggtctctgtgtagttaatctgtgtgactcagcatggggagacgatagggaaaatcagtctctgtgtagttatctgtgtgactcagcatggggagacgatagggaaaatcagggtctctgtgcagttatctgtgtgactcagcatacatgggtaccgcatggatagaaaagcatgataaagtttgaaaaagtatttttaagtgttgatgatgatgatgattttgaatgcaaacatactttgattgtgatgatctcttcaattatgatgttgtacaaaaccaaaaaaataaaaaacaaactgatgttcatcttcaatttgaggttaagaaaactcattatattcccagcataccttcttgttgattgaatgattgaagagtaatcagcaaacaacctaatttctaaatccttgacagccataatgataatgtgaatctcacttggagaaattctcatcccaaattgtgttccattgcttcataggaatgtactgaatccgtttcaaagatcaatgaaaataatggcatgctcatatattggatttaaacatcttatatgattgtggttattgtgttttttttttttttaatttctgaaaacaaacaaaaggtcctaggagaaaagtaaacctccgtctcctgtcaagtcccttctcccatacctgcgtctctcattgaaagggtagtacagaattcaggttgggaccaacccgtgtaaccagcagtgataactagtcgctttattcctgaaaactccaggctgtgattacataagcacaggtgaatggggaaaagcaaaagccatggaggaaatccacctgcgctttcttccccctgccagcccagctttcacccaggactgttcttcatgggctgcacgcctcttgccactggtattcttaagcaagtgctgggaagactcgaaagaaaagtgtgagaggagcagcaggcagcgggtttggggaggaatgaaaagcagagatggacaatcctatggttttgccccgaaagaggacagagacttcactttactgagtctgtacaaacatctggaatcaaagccaagagaatgactgcgatctaagcctttctctaggccccaagtttacagcagtttatgctcctagaaagagaataatcactgcatttacccaactaaatatttctgtctatttctcatgaaaagtgaggttaaaggttaatgtaagaccattgcagcccataaatttaggatgactgtataatccttccagctttgaaattgtcataccttttttacttatccaaaatatttctaaaaacaacagaaaggtcttgacaaccttgatgactttatggaatgtgagataaagggcgatatatatacacatcacatatacacacacacatatacgtatatatacacatatatatgtatatatgtgtgcatatatctatacatatatggtgtgtgtacatacatacacaccatatatacacacaggatgtgtatgtgtgtgcgtatatatatattacatctatttacatatatatataacatttcctttgattcaatttgcaggcctcaatcttattctcagaactgatgtcacaacatcgtacaaagccctcataagcatatttgccttccaaggtaactcacagaatacatcttccatttgttattcatatagtcagctctagctgcaattgccatttaccaattcccatctgttagaggtttttcttgtacccgatggcagttgaagcagattgtgaatataaaagaaaatagtttcttggcacagaaaagggatatttgttttaattgacaaggtgtaacatttatgagataaaaatgaattttagacatctcatttatttttatgtcggtctcttcaagacaattattggctcttaggcatacatacagaaacctcaggaaattagggaaaagacagaaaaacaactcttgggaaagtcaattcaagctgatcttaaggctcccagggaaatggcaggtttggagggtggagagaattcaggtgacagtgccaattcttagtgtcttctgtgctaccatgattattttagaaaataaaggagtgctgattttttaaaaagcaatttcctctgctcagcaatgataaataaatcattttgctataaatgagtctagagtcaatgcttcaaatgagaaaaaaagcaatccactatttctccttaagaatgattatatatttgatgagtatctttcttctgataatgatttgtaaaatcttatttcttggtactcccatgagtagtagaatatattgaacagtaaaatgttaaacagtttttgagatgaaggcactgtttctattcaacttatcacaattactgagggtatcaggtatgtactggattgtcatagcttaaagagataccaggacgatgacaaaggaaagttgaagttagctattctgatcagtagaaggacacgcttttccccgcaaaggaaataaaagtgttagtgtcgttctgttgagataattttatcaaatagaaaaaaggaataaaaggaaagtcatctgtgcatttgtaacccagcgattctcattaaatcattataccatgctaacaagagaaaaaagcgtctacaggtggtactccattttcaactgggaaaagagcaggtctaatttgaaataacccaaggctaagggtgctataggatggaaggggaatttttaatcaacactatgggcacacatcaggtgtccccgagggccacgctatgaggaagaacctatgatatgttctatcttcttgtaacagtgctaccctctgggagactacttgcccagggctgggaatttatctttggagttagtttaggactcagggtgaaaaggaggagcagtaggaagtgaggctattggaaagcttctgtaaaaagtggccccttcattattattccatattctgactaagcagagaaatgaacctgtagtttcatccatattttcaaaagcaaaacttcttctactaaaataacttgctacaaaaggtatgtactagtttgggattttgtttttttctgtcagtttgataaatgctgtttggactctcataatccccctaataattgactggggtcagagtatctctagggcgatgctgcacattttaaaaccgcttcacggggtgctggtattcagagaatgctcttgaagatctgtttcccattgacttttcaaatcctgttaattgcttatacagtaagcgttaaaagtcaggcctggcaaaatcaaggaagctgcagggagcagatgaagttttcatgcgcaggagcacagctaggatgaaacgagaagtaactgccgtgtccagtgtggcccaggtggagagctgggggtgtgccatgagactgttaggtccagaggaagtacgctcgattcgcttgatctcgggggtaactgaagagatagcagctctctctagaagtccttttctgaaactattgagacctctgacacttcaaatccttaaacgcaggaaaaactaccaattgattagaatgcccttgagaagattgaagtatgagatggtgttggactagtggtcatttgtttcaatctcaagattctgtatttcctattctgaaatttctatttattataaatcttataatctttaaaattctatttttctaagtctgagatgtggttgaatttcagtttataagaagaaataaggcatatgtgaattcccttaacaaatcacacagttcaattcctgatagttgttacctaacgtttataatgtttctttttatcaaatgatcttcaatattccctgccatgaaatggaagattagtgaattttttactaaattattttggccttaaagtctgttctgccaaattgaaatacttggacagaactaacttttgctgtacaaagtggacagttagccatggagtgagctattgagaagaaagaatattttctgagcagaaaactcattcttctttttctaatagctgtattaggagattgaattggggccactatgctctttctcttgggcaggaaacatgtactttttttgcagtcagtaatgttttcatagctgttatctgacccttacactgagcagaagagtttctgggacagtttctttaagtttacaaataatcagccatgtataggcttaaaaaataaataaagatttctcatccatatgaatgagtggagcaaataaattagatgagggaagctggatcacaatcttgagaggaaacaagaggaaaattcagaaaacatttcacctatacctggttctgttaataccttgccactaccatattatggatgcaggctgaatacatgttttcagaggttagcactgcagccaagcaagcaagcatactgttaatctgatatatataaggacacacataacttacaatatagtaaagcaaataggcttgaatggcattgcagttcacacacactgccatggtgttgctattcaacttctgaaacataattttagttttgtcctcttgcctcccttgccttgctatagtgatttagctttaaaaatgcaagcctgcacctgtcatttccctgctaagcatctctattggcccccatgtcctcaaggatgcagaccaagtccattccagaacagcttccatgctccagtcctacccacctcagtagccctatcactcttcttactttctgctccaaccacaatacaattctagtggttgatcaaaatgtttctttttctttttttttttttgagagggagttttgctcttgttgcccaggctggagtgcaatggcgccatctcggctcactgcaacctctgcctcctaggtacaagggattctcctgtctcagcctcccaagtagctcagattacaggcatgcaccaccacgcccagctaatttttttgtatttagtggagatggggtttcaccatgttagtcaggctggttacgaactcctgaccttaggtgatccacccgcctcagcctcccaaagtgctgggattataggcatgtgccaccttgcccggcctcaaaatgtgtcttgatacaaagatttcccctacactgtaatgttcctctaatcctccctctcataacagctacttatccctcgggtttcatcttaaactttacatttagggagaaccttcccccacagagcagacatatcaggtcccctgtgtattctctaatggcagtcttgtatttctttgtaacaaaaattgaatttatttaacatatgactttcctaccattaagtcttttacttgaacgagggcaggtattcagtaaatgtttcttgaataaataaatgcatggtagttctttatcatttattatcattggtctagtcacagactcagaagcagttggagatactagtatgattgaatttctctatttttagtttctttcaaatacttgcacacacacagacacacacacacacacacacagacacacacacacacacacacacacacagcttccttgcagtttcccagaaatacaattccagagccacaggtccctcatctcacaacttgtccccatgttctcatttgtccctctgatcttacttgtcagcccttcccagcacctggggatcgtgcattgtgaagcagcacactcaggggttccctgctccgtgtttccctccctaatgccaaagggccaggagccattgtgtcgcagagtaggctgcttcacttgtgcctgagggaggacagacaatatgctcatcaggattcagggaggagagtgtggacgctcagacagaggagtgctgtctttgtttctcgctgctatatcagaatgccacagactgggtaatttataataaacagaaatttgcttcctcacagttctgaaggctgagaaggtcaggatttaggggccagcatctggtgaggggcttctcactgcattcttccacggtgccaggtggcagtgcaagaaagcacataagacacacagcaagaggaggctgaactcacttttataacaaacccactcaccccataatgaatttactcctgtgttcaacacataaacttttggagacacattcaaaccataacatgtactattgaaatggagctctgacaggagacaccttgggtgcctcaagctggagattctgctttgcatccccagttaataattagtagataaaagaaagagactctttgggcactgggacctggggtctatgaatgttgaaaaggaagagcaaaccatgacatcaggacttgagtttctcacacccctttctcccacccccacccaggcaaaaatagatacaaaagaagaaggaattacagaagaagtcacataacattattgcctacaactgactgtttaccttgaatacttgaagaccagaatgaagattcttggggtgaagaattacagccttagcatggagcaggcctcggtgcatcggctttcagctaggcatgcctgccaatgttcaacgtcctcctgggatacggaaggcaccgtgatagacatctgggcaagtcaacaggaaggtggatatccaaatctctctcttcgcaatgagtttccagttagatggaggagagagtaataaaacacagtaagtgtggaaaagattaaaatgcatgttgtgatataccacaggaaatcagaggagagaggttcattctaaggggaatggtggaaacgtcagtgagaacataccacctgggtggttcttgtaagatgatgtggaagagaaaaggtaaagattgagcaaaacagtgcatgagcgaaggatgcaatgtgagatggtctgaacagtttaaaagaataacctgggccaggcacggtggctcactcctgtaatcccagcactttgggaagccaaggcgggtggatcccgaggtcaggagttcgagaccatcctggctaacacggtgaaaccccgtctctactaaaaatacaaaaaattagccgggcgtggtggcgtgtgcttgtagtcccagctacttgggaggctgaggcaggagaatcgcttgaacctgggaggtggaggttgcagtgagccgagatcgcgccactgcactccagcctgggcgacagagactgactccctctcaaaagaaaaaaaaaaaaaaagcataagccgagggaatgaaagtactttctgtggctggagcacaggatgtctagacagaagaatttggaaagaaacagaggatactagatttggaacagatcattcaggtcctcaagaccttgaaaataaggctacagtttttaatattattatactgcaggccattgaagataatgcacttgttttgtattgtttttgtttttcagaagacagagtattaacttttttttcaggttgtagaattcatcaattccataaccatttttgaatgagtattacaggtcaaggacttttctaaaaagatggatatggtctcttctgtcatgggtcttacattctgtgggaggagacaagcaataactacatacaatgagcacaataattgaagtgattatgtgggaattaaaggggtgggctattgacaacttcagacaccatggtaattaatggccttcgatttgtaacaggagctgagattcctgacttcacagatccctgaggagatgtttactaaagggaatcttctggtcactgttaccttcctccgtacttacctgcctcatggagtaagcatgacaaaattcttgattacatagggaaaatcacatcttcgattaatactttcctgtttttattcttcattactacttgcatgatattcacataatcttttctcttctcctgcttcctccgtgcaataagctgctcaggcagcctttgctcttaagagcttgtttgtatctgagaacgagttaaggctttacactggtagtaagtttaagtcatgccaaaaaggggtagaatacctgattctcctagtttcaagacaagccaggttttttttgtttgtttgttttttaaaaaagcagaaactttcattgctctctctcatctgaaactagatgaggctatctactctgagtggccaggtcttctgtaatttgtaactgaaatgcaggttacttgctcactgcacgtacagttcagttaacgagggaaatctgatccaaaataagtgaatttattccgaagttagcttgggggaaggggcacaaagcatcccgcctttgaatgtgccgcttctcctctgttgcaaaaagtgggcattttcatagggtaagggaggacatgagcaagggcaggggtcccactgcttctggtcagttacctaccaggcagttgagttggcaccttcctgtgcagagttcagttgtaaaagtagccaagtggtcatgctttcgatgtgctgtcctggtgcgtatgagttcctaggtcacccctggaggatggcagttccgaggcacgcccctggaggtgagagttccatggggacatgctttggtctgtaaatccaccgtcagctctggaggagagacctgtcttggagcacgaagttagaggaacttgctgtgtaggcaatgtcctgtgagggagaggtgagagattatatttgcatttcagcagagctaagcagaaagcagagagccagggaaaggagaaaacagagtgagagggaaaaatataattaaaccacccgtagaaaaatagggagaactgggggccggggcggtggctcacgcctgtaatcccagcacttcgggaggccaaggccgacggatcatgaggtcaggagttcgagagcaggctggccaacatggtgaaaccctgtctctactaaaaatacaaaaattagctgggtgtggcagcaggcgcctgtaatcccaactactcgggaggctgaggcaggagaatcgcttgaacccgggaggtggaggttgcagtgagctgagatcgtgccactgtgctccagcctgggcaacaagagcaaaactccatcttaaaaaacaaaagaaaaaagaaaaagaaaaatggggtacttggttacattttaagaacctaaaaatctagaatttcatgcaaaactcataattttcaagttggtaattaattttcaaatgtaaacatattgtggctcgcaaagaacaataagatcaatcaaccaataaaggcaaaaatagagagtaaggaagaatccacactaagaagcgtgaagacttgattagagacataagccaaagaaaggagatgtgttcagtgtttactgccatgtgccaagcaggggcgggtgaagacaatggcaatgtgaacagctaggaggaaggcaatatctggtaaattagagccgatgacatatgagtccaaaggagaaaagaggacgctgaacccaagcttgatgattgggagaatggtggtcccgtgacttgtcccaccgaagccaaagaaagaacagatctaagggatggtgatctttgagcaagctcgtttccctcacacgttccagcgctgtttcacgccaggctctgggattgaatgatatccctggatcaggttcactggcgtcccctgctggcacagagcagcacaaagacttcgaaactggatacgctgataaatttatgaaatctccacaaactagagaacacgggctaggtgcggtggctcacacctgtaatcccagcactttgggaagccgaggcgggtggatcacgaggtcatgagatcgagaccagcctggccaacatagtgaaaccccatctctactaaaaatacaaaaaattagctgggcatggtggcgggcgcctgtagtcccagctacttgggaggctgaggcaggagaatcgcttgaagcccggaggcggagcttgcagtgaccagagatcactccactgcactccatcctaggcgacacggtgagactctgtctcaaaaaaaaacaaacacaaaaacactagagaacatgttattaaataatagaaagaaagaatgcccatctgataaaggtacaaaactgaccttaaaatgacttagcactggaaagaaaaaaaaaagaggctacaaatttttggttactgaagagccttttaaataagattatattaaaacagtgggtagatctctccaaagcagaataagaaaacccctaatcttcctcctaactaaatgattatatgatttgatgagtgaggattaagttctgcttttaaatataattgctgggtaatatgaatataaaccaaatatgtaaaatttaagatacaaagatcaatattcccaattctataaaatttgtgtcaactaattgtagataataaaatattttatgtattttttagaagaagataataggcataacaactattgtgaaattatccaaatttgtactcttagttgccaattttcagttctttagaaagtgcaattattcttagcagtgagaaacatgagtctcacagaatacatttaagtcttcactttgatttacaacctccagtgttaattaaacaaatgccaactatgctaatagtctggaaatcctttgacaaatactgaaagaaatgacaggtctggcacatacacatatagatggaggcttgcctgatttttaagaggcgttttacagatttggccttataatacttattctataactattcattttatcctggaaaatgttgtctataaagttttggagagaaattgctctgtagaacaaattgacatttcacaggaataagtccactattgctaagaaaaatggtactggggatggagccccaaaatggcagaggcaaacacagccctatcaacctctcccatccccctgtgtacacattagtatagacttagtctgtctttaggaacaacatttttactgacctgctttctaagttgttggtccctcctcttccctgggatctacatatcagggtagtttcataattctctgttgtctcagttacgtgttaaaagtaagcatgttcactgagtgatgattttactttttaaacaacctcatcttttaccgtaccatcagttatattaaatatgacatttaaggttttaaaagtggagttagaaagctacatactgagaggtgaagccaggcgggcttctgactcatgtggggacttggagaacttttctgtctagctggaggattataaacgcaccaatcagcactctgtgtctagctaaaggtttgtaaatgcaccaatcagcactctgtaaaaacggaccaatcagcactctgtaaaatggaccaatcagtgctctgtaaaatggaccaatcaccgctctgtaaaatgggccaatcagcaggacgtgggtggggccaaataagggaataaaagctggccaccagagccaacagtagcaaccggtttgggtacctttccctatgaaagctttctttcacttttcacaataagtcgtgggtgcttctcactctttgggtctgcactacctttatgagctgtaacgttcgtggcgagagtcggtggcttcattcttgaagtcagccagaccaagaacccaccagaaggaataaattccagacacaatacaatatgttgggtgagcagatcatggcacttatgtcaggaaagcttgtgtttaatcctgggtgtgccatttactaagtgtgtgattagttgtattatatatacatacacacacacgtattttttgagacagagtctcgctctggcacccaggctggaatgctgtggtgcaatctcggctcactgcaacctccgcctcccaggttcaagcgattctcctgcctcagcttcccgagtagctggggctgcaggcatgagccaccatatccagcttttttttttttttttttttttttggatttttagtagtgacagggttttgccacattggccaggctggtctcgaactcctgacctcagacgatctgcccacctcagcctcccaaagtgctgggattatagccataggccactgcacccagccgtatcttttaattttaatacccaaatgtattatcaagctaataaatttgaataaaaacaaaatagtaaagctaatataaatattaaactttttacacaaagaattggttctttaaaaaggttagcaaaattgagaaatctttgctagaatgatttaggaagaaagaagactcaactgaaaatcagaagtgaaagaagagacattactaccaattttgcagaaataaaaaggattgtaaaagagtactgtgaacaattgtataccaacaaactgaacatcttaggtgagatggacaaattcctagaaacacacaaatggccaagattgaatcacgaagaatcagaatatctcaagagacttacagtaaggagattaactctgtaataaccccccagcaaagaaaagctaagggctagatgacttcactggataattgtagcaaacatttaaagaacaattaaaacaaatctttctcaaactcttaataaaaagcaaagtggagggagtactgccaaactcaatctacgagaccagatttaccctgataccaaaatcagacaagtatactatgagaaaagaaagtacagaccaatatccctgattaatactgatgcagaaatcctcaagaaaatactagcaatcagaactcacaagacattaaaagaattttacatcatggcaaagtgggctttagtcctagaatgcaagaatggtaaatatatgaaaatcaaagtaatgccctacattcacagaatgaaggacaaaaaccatgtgatgatctcaactgatgcagaaagaaaaaatttgacaagatgctctattacaaaacactcaacaactagtaatagaaggaaacttcgtcaacacagtaaaggccaaatataaacacccagaactaacatcgtactcaatggttaaagactgaatggtctccctctaagatcaagaggagcaagacaaggatgctctctttcaccgtttctgttctacttagtgttagaagtcctacctggagtaattaggtaagaaaaagcaataaaagtcatccacatgagaaaggaagaagtaaatttatatctgttcacagatcacataatcttatgtgtagaaaaccataactattacataaaaatgaattcagcaaagttgcagaattcaaaatcaacacacaaaaatcaattgcatttctgtgtattaatgatgagcaacccaaaggaaattaagaaaacaattcaatttacaatagcattaaaaagaataaaacacttaagaacaaacttaaccactgaggcaaaagacttgtactctgaaaactataaaagaaatatatacataagtggaaagacatcgatattcatgaattagaagacttatattgttaagatagtagtgttccccaaaatgatctacagattcaatgcaatccctatcaaaatctcgaccttttttgcagacatggaaaaattcattgttaaattcaaatggaaattaaaggaatctatgatagccaaaataatcttgaaatagaaaaacaaggttagaggtctcgtacttcatgatttaaaaactcactgcaaagctacagtaatcaaaacagtggttattgtcataaagacaagagtatagaccaacaaaatggaatagagagcctagaaataaaccttcacatacatggtcaaatgatttcaacaagggtgccaagaatattcaatagggaaagggcagtcttttcaaccagtggtcctgagaaaacaagataaccacatgcaaaagagttaagttgaaccattaccatagactatatacaaaaagttaactaaaaatggatcaaagacctaacccataagagttaaaactataaaactcttaaacaaaaatataaggggaaagcttcatgtcactggatttggcattgattatttggatatgacaataaaagcatagataacgaagaaaaataagtaaattggactacaccaaagttaaaaacttctgtgcaaaacaggctataatcaacagagtgaaaaggcaacccataaaatgggaaacatttgcaaataatataactgattagagttattcagaatatataaagaactcttacaactcacacacacacacacacacacacgaaacccaattaaaccattgacaaaagccttgaatagacatctctacaaaaaagatacacacatagctaataagcacatgaagagatgcttgataccactaattgttagagaaatggaagtcaaaaccctgactggcaaaacactgtgacaccacttgatacccattaggattgctactattaaaaaaaaatcagaaaataacaagcattggcaaggatgtggataaactggaaaacttttgcatttttggtgggagataaaatggtgcagccactatggaaaacagtatggtggttactcaaaaaattaaaaatagaattaccatatggtgcagtgatttcacttctgggtatatatcaaaaataattaaaatgaagcacttgtacagatatttttgcacttatgttcataagcagcattactaacaatagtcaaaaggtggaagtaagccaagtgttcattgctggcggaataaacaaactatgacatttacttacaataaaatatttttcagccttaaaatggaaggaaattctgacacatgctacaactgtaggtcattatgttgagtgaaataagccagtcataaaaggataaatactgtatgattctgaaacagaccgaatagtcccattttttaaaaaaaattttgatgaacatagaaattgacccctttggtattaaagtttgaaacttatatttgttttttctgagttccttcttcaggaaatgaccttcaggcctctcaaaaaaaagtattaaagaactgaaactcacccagttaccacatccagacaatgagatgccagacccctcattcatcatgatggcttccttgcccctcactagttcctgtttccttacacattgttacattccttccctgctatataaactcctagttgtagttggtcagagagatggatttgagactgagttcctgtctcctcggctgcagcacccgattaaagccttcttccttggcaatactcattgtctcagttcttggctttctgtgcagccagtagaagaacctagactgaactcctggtgtttcactaatcatcccacttacacagtgtacttagagtagtcacattcatagagacagaaaatagaatgggggttgtcagcagctggtggaaaggcaatggtgagttcttgtttaatggttagagtttcagttttacaagattgaaagggttctggatatggatattgatgacggttgcacaacaatgtaatgatgttcactgaagtgtacttttagaaatgttaggatgataatttatataacttttttttttttttgagatggagtctctgtcacccaggctggagtgaagtggtgccatcttggctcactgcaacccccacctcctgggtcaagagattctcctgcctcagcttcccaagtagctaggattacaggctaccacctgtgtgattacgggccaccatgcctggctaatttttgtatttttagttcgagatggggtttcaccatgttggccaggctgatcttgaactcctgacatcatgatccacccgccttggcctccaaagtgctgggattacaggcatgaggcactgcgcctggcttataacattttttttttttttttgagacagagtctcactctgtcgcctagactggagtgcagtggtgcgatctcagctcactgcaacctctgcatcccgggtgcaagtgattctcctgcctcagcctcccaagtagctgggactacaggcacctgccaccacatctggctaatttttgtatttttagtaaaggcgaggtttcatcattttgcccaggctgttctcaaactcctgacctcagataacttatgtaacttttatataggtatattttatcacacttaaaaatattaacacatcttaagaaattcagccaacccaaattgctgagatggcatggaggtatggaaagagcttttcaagctagaaagacctaagtttgaaatgagacctaagttctactacgttctaatgctatgacctcagagatgtcatagagtcacgttgacactcagcttcctcatattatgcgatgaccacttatagaggcatgatgaagagtaattgagattatgttatttacagtctctggcacagcctgtggctctccacaggtacactgcaatgaatcttcctttgcattttcctcaggtaatagtaaggtgtaattgactacaaataggtctctatgctttaaatgtaaatattaatttcacttagatgatctaattcagtttttacagcatgctatggtttacacaatcctttatatagtattttattttcctaacttttgaggtaagcattacgaattatattttaacaatggatgatctgaatataaaagagattacaggatttgattaagatcatatattgctgtgattcaacaccatattttcttaattcaatttcatcgttatttatatggtacaattaggaaaggaaaaagtaatccaagccctatattaaaccatacctgttgctgagtgtcttcaaaatcattttattttccttcctaagataaaaaaaaaatgatagaatcctacgtgcttgtctgatgattcgtaacttgaagtcagggattagatctcctctgtttcttagttttattctatagcccatgaatatattaagcattcaatagacatttgttgaattaaaatggtataaactattgatctgaaatactgcatttgaagcttggtacttcatgcattttgttcatatcatttatgtactaaattcaactttttttttattttgcatcctgattgtgttttcataaacatttattctaatgctaaaatttaatatcaataaattatatcttggagaaataatttaacaaactcatatttgcttggtgtgattatcaagactgcagaaactttggcaatataacataatggggaaaaaattggacaggaatcagaactaaccttcattatgggttcctggaatagctccaatctattcaagtaccctggagccaaacatttaaatgctccctgcctggatttctgcatttccccaatggagatgataatatttatctggcctacgttgtaagcttcctttttctacaccatgatactcagtatgacatagaggttcaaatcacttactattttcataaccataggcaaacctcttcacacttccatctgtaaagctgcctaataatagtatctgtgttctagtttatcatgaggattaaacgagtgaatatttatgaagcgtgtaaaacagtatttggcacatatgcaaatgttggttaaattttatgtgcataagtgtgtgtgcgcactttgaaaagtataaaaatatatttataatatcaggtcaattaatattttttctctctaaatgctactctagttatgtatatgcacttcaagtacttgacttttagttttctcatctgaaaaattgcattatcttttatttaacttatatttttgatcattaaatgctcttaagtactccatgctcagtaagacagataaatggagaaatctagcatgaagttagaaattaagaaggcatattgtttctataaaaaagaacaattttaacgaggaaagacagaaaacaagaaacataccattgaggccaactggtttataaggtgttgttactcagtcccagattttaaggtgcaattctcacatatgaattttcatagaggcctttgaagaagagaacaaagtctatgaaaatgcagccagtaaaagatcctccccttccttgaactacacccaacctgacttcagatgcaggttgcctttacttggggacgtgtgtggccgagaggcaagaggggtttcccttgagtagaatagaacttaaagagccaacagcagactcctcagatgctagtaacttgccaccagtagcgtacactgtgtccaacacgcagaggcaggtttgagtggaattcccagatagcttgtgatcaaagactggtcgccagtgaagaagacttgggatggatggatggatgggtggatggatgggtggataaatggatgaatttaacattgaggtataatttgcttaacagtaaaatgttcagtttaataagtttaggccaattaatattaattttgattaatctcaaattgtcttgctatcgagtgtttttttaagacagcaccaagtgtaaaggaaaatcttgagatcattatgccaaagacaaattgactccataagattagtccaaattatcaagtatattccatcattttgaatactcataaaacatattttgatttttattattttaagtgaatatttggtgatttcaaataagcaaacccaaattcaagaactttcactgtgcagaaatttccaaagtcaaaaccaaatagcgagtgtgataagttatactcattagacagcaatagagaggccccctgtaatggaatatggggtgactgtgaggatgctgaagaaaaaatggccatgattttttatctaaaggtgtgcttagtaaagtaggaatagaaaataaagacaaatatgcaactccaggagttatgagaatgtattcgggacgtattttgaaaacaaacccaactgctaaaattgagtcgacccagaaaagaattaagctgagatatctcttagtgatactttcacatccagatttacgcttagattcatgatgcattacaactaataaaattgtttaagtatgagaaagagcagaccaaggggccatgaagaaaatataattaaatgcagattaaaggggcagggcttctggtttggcagacacttacacttcaaagactggaacattctctttaataatacctcagttatctaataaaaatgatcatttggaaatcatgctggtcacttctgtctagctcaagtgtcaatgttctggatatactgggtactttattcacactgaattgcttttatacatcgagaaaggtgttaactcttactcttcttaaaatggactgtggtaattaattctgatgcctggaagcaaataagtaaatctttgaaatattcattttatttatacagacttagatatctactttttaggaaaatcacacttaaatacccctttcacttttgtacatatttgacacagtttggtatcaactgttactcggattatatagaaatattttgttgcaatgaatttatccaatttccttaaaggaagaagcaacaatggattatttcaaggagaacattatgtaatagtccatgctaatgaactgttaaaaaaatattattgacacaggcatgttaatagcagtgtgggttttggtaatcagctaacataattagtccagaattatatggactttttaagtaataaaatttactggaaacttaaatgtaattaattaaaagtttggtttagttataaatatgattaaagcatttttctctaattttttttttttttttgagacagagtctcgctctgtcgcccaggctggagtgcagtggccctatctcagctcactgcaagctccgcctcccgggttcacgccatgctcctgcctcagcctcctgagtagctgggactacaggcgcccgccactatgcccggctaatttttggtatttttagtagagacggggtttcaccgtgttagccaagatggtctcgatcttctgacctcgtgatccgcccacctcggcctccaaaagtgctgggattacaggcgcgagctaccgcgcccagcccatttttctctaatttatacttaaatttgcattattatttgcaaaacgtaccaaaatttggacatttaagcatcatttattctgaaaaaagtataagacatagtaaataacataccaatatgggacatgggagataaaaattgatcacccagtagataaagggaaaagctctttcagaaaaaaaaagtaaatttaattggcatataatcagaatatgtatgagcattttggagttcttgttttcttgttaactaaggtagaattttacaggtttgtagaccaaggcttcatctccatgaatgtggccccatgattaagatggcttggggtcagacagactcagtcctgctgtttgttagttgtgtaacatcagacatgctcaaagcctcaacttactcattttggggaaataataataattattaagactggtgagggccagctcggtggctcacgcctgtaatcccagcactttgggaggccgaggcgggtggatcacgaggtcaggagatcgagaccatcctggctaacaccgtgaaaccccgtctctactacaaatacaaaaaattagccgggcgtggtggcgggcgccggtagtcccagctactcgggaggctgaggcgggagaatggcgggaacccgggaggcggagcttgcagtgagccgagatcgcgcccctgcacttcagccccgggggacagagcgagactccatctcagaaaacaaacaaacaaacaaacaaaaaaactggtgagggttataataaatatatgtgaattaaataaaaatgtgttttaaatgtcatcaattgttttatatttcttaataaatttctcttttgtcaatttcattattcagcaaacgcagaaacttaagattttctgctgtttgtagtaatgtagtatatttcatcatatggcaagtgctaccagagagaagtaggattattatttattgtggtttttgcaaaaccagaggcccatgccaggagttttattcagcacggctcctctttgattcctgtcacacctagacacaatgaaggtgatttgcaaaaaagtagaagaaataaaagaaaaacaaaacaaaaactcttcttgccaagatttctaaagtaatgaagaaataacgtcacttgtaaaaggggtttctaaaattacctatctggaacagaagaaagcaagagtccggtacccctatcaaatcaattggtttaacatgttttcccttttaaagtaaaataataatttaaataataaatacacatttttatttatataatgccatttttaatatagtatcatttttctactgggattttatagtttaatagacgttcatcattagtgtgctgtttcaaatcctggccctgctctatattttttggttggtttgtttggatattattaccataaaaacaaaaacaggcttgcaatggctgcagattcacagaagattattagaaataaaagtttattgttaaatattttgtcatagcaaaatatatttttctttaagagaaaaaagtttttatctaaatattatcaaatttattactttcatcacttacgtaagttaaccagttcatatgcatctgtatgtctcagtagagaccaccaacttcaacattaatgtgttttattttctcaaagttggacttcagacaaaaattataaaactggaagatagtaatatttaaggatgccttcctaaaattatcttaagtacatcgaatatttccaaaaaatgtttttcctctgagagtttcctatgctggtaagaaatattttgggaacagaatagacaaggattaagtgaaaaataaatgtccctttttactcttattccagttctcagaggaaacagtttcttgcacggacttccagttattttctatacataggaagtatattatatataacaatataaaatttatcatgaatgaactactctatacacactctgacagttactttttaagttaaacaatatctcgagtgtctcacatatctatactctcacaagtattacatatatattacatacatacttgcctaattagtttttggtgacaatatattgtattattatatgaatgtactataatttttaatagcaagtctctttgcaagtgtagctccagcttctattaggagtgaaatccctggataaaatataacttgtctccaaagctgattctccaaaactgtttcaatttccattcccgcatggtaatatcaatagaataattgcccattgtcccacaacctgtttaacatggtcacacagcgggattctgactttgccaaatggctcacttcaataagcttaatgaatgtttaaatgaatgaatgtcaatttatgaatgaggattaccatcttctcatacacgactactgaatgtatctcactttctgaatgggaatcatcttctcatatactaccacttttttttttttgaaacagggtttcactctgttgcccatgctagagtgcaatggcatgatcatagcccgctgcagccttgaactcctgggctcaagctaccctcccacctcagcctcctgagtagctaggactacaggtgtgaaccaccatgcccagctaatcgtgtgtttgtttgtttgtttgtttgtttgttttagagaacaccaggctggtctcgaactcttgggctcaagtgatcctcctgcctcagcttcccaaagtgctgggaatcaggcatgagccactgtgcccacccttatactaccttttttttttttttttttttttttgagacggagtctcactctgttacccaggctggagtgcagtggtgcaatctcttctgactgcaacctccacctcctgggctcaagcgattctcctgcctagcctcccgagtagcctggattaagggcgtgcaccaccacgcctggctaatttttgtatttttttatagtagagacggggtttcaccatgttggccaggatagttttgaacacctgacctcaaatgatctgcccgcctcggcttcccaaagtgctgggattataggtgtgagccagtgtgcccagcccccttatactacttttatatgtcttgcctggttttttcttctgaccagatttataattaaataactggttttttttcttactgactttcatgaaattttaatttatcaggaaattagttctgttgttaatttatgttgtacatatttactctaatttatctctcttaaaatgttttgttttttggccagacgtggtgggtcatgcctgtaatcccagcaatttgggatcacctgaggtcaggagttcaagaccagcctggccaacatggcaaaaccccatctctgctaaaaacaaaaattagctgggtgtaatggtgcgcacctgtaatcccagctactcgggcggctgaggcagagcaatcgtttgaacccgggaggtggaggttgcagtgagctgagacctcaccactgcactccagcctgggtgacagagcaagaccctgtctcaaaaaaaaaaaaagttttattttttaatatatacatactttagtgggacataagaatgatttagggcacttcaatttgggtctattttttctttcttttattatactttaagttctgggatacatgtgcaagacgtgcaggtttgttacaaaataggtatacatgtgccatggtggtatgctgcactcatcaacccgtcatctacattaggtatttctcctaatgctatccctcccctagtcccccagcttctgacaggccccagtgtgtgatgttcccctccctgtgtccatgtgttctcattgttcagctcccacttatgagtgaatatgtggtgtttggttttctgttcctgtgttagtgtgctgagaatgatggtgtccagcttcatccatgtccctgcagaggacatgaactcatccttttgtatggctgcacagtattccctggtgtatatgtgccacgttttcttgatccagtctgtcagtgatgggcacagccacttgggcctgttttctagggacacgtctctctgcagatggttacagcctccttcggtttgcgcagatcgccctcagacgaaatgtcagcatgtctctcaatgaagctctttaatccacagtcgttttgttttcagctcagttgtttctggtcggtgcaaagctgactgcagtttttcttctcttttcaatgtttgtaacttttcttctctgtgcttgacctctaaattaggatttgtgttgaagtaaagaattgtaataacctgcagagtcacccttaaatctggataccccctctttctctttctctctcagaatggagtactccagagcaatgttctccacttctcccacggcattatcgcacccctaagtctctcttctaactaggatattcttctctgggttctcaggtccctggaggtctcagggacattgatgccatgttcagggtctaaaaggtaaggtttttgtgctttgtacttcttcagtttggcccagatgtccttgtattcgtgagatatttttcacagtgattcctacagtattttaagatcagttctctcacctgtttttactctttttgtctacataggggatatcagagacaggatataaatagtaatattttattctttcaggaagctataaatgtatttagattattacaatttgtacagactctaagcagaaatataatcacatcatttatgatatttatcttcataaatagatatttgaattggcttccaaaatgaccttagagatgtacttacttaatgatggtggccttgatctttttgtgattagataatagcccagcatgtggccacagtagcagaaacacacagtatgtgctggttaattggctctactcgcttcatgcattattacagcttatctgctgcttgtggactggtacatgttgagcttctcaataatcaaagaagaaatcaggtgccaggtcacaatccagacccaagaagtgtctgcttttctgttttccacatgaagtcatcatttagcattcttttcttctttttcaatggtggagaagcctctggtatgtaaaacatgagtaaagttcaaatagggtcaaattccggaaggcagcacagaacttttcctcctagccgtgttactttggccgtacatccttctatcatcccatgcagctgggaatgggggctgccattttcattttgatcaaccattcctcaaaagggcatttagagagtcattagggtctagagtcatgaaatgagtagaataacagaaggtagcatgtcagaagaccatgggcagcccccaggctgtatttgcagtccccgttctgcataatgtgtccagttggtatgtaatgatgcacgcacagaagagaaccaaacactcaaatgttttggctataatcaaaattataccttgagtttcaatgtacttatgtctttgaaaatggtattttaaggaccagaaatgtacacagtgttctgtgttttcaatacacaaaaataaaccttatgcacgtaagtgtaggcctcactgctgggctgtattccttcctaccacggaccctgtaaatactgtagaactatccaaacaacatctaaacttcagatgtaaaattcctaactcctaatattacaaacattcaactattttgatggaaaaaataggaagcatgacaatcatttataagagaaagaaaatatatttctcaatgaacacagattccttgacatggacactttcctgcagcttccgaagacaccagcagtggaaggttatactattcatcgatggccagggctggttgcaggagatattatgatgctttgaaggttgtcctggtcatctttataaaatatatgtcaaccacacctgctgaggctacagagcactgacagagggtaagagactagagaaggaaaagctttgataagatagctgaagataatcagaaaagatggtaactaatcaaataaacatcctcttgcgtgcacaatgtcaggaatgcagctctggaaacaatgcctttgtcagagcactgttagccgtagggtgtgtgccttcctcctcttgtgcttagtgtttggagaatttttgttcgtttgtttgagacagagtctcactctgtcgcccaggctggagtgcaatggcgcaatctcggctcactgcaacctccacctcccgggttcaagcaattctccgcctcagcctcctgaggagctgggactacaggtgcccaccaccatgcctgcctaatttttttgtattgttagtagagttggggtttcgccatcttggccaggctggtcttgaattcctgacctcgtgatccaccctccttgggctcccaaagtggtgggataacaggtgtcagccactgtgcccagcctgagaattttaaaaagaagtagaaaagtgctattcttgattaagcagctgtcatatcagacactggagaatgtggcccaagctcacatggttcatttctgcaacagctcttgcaatctatacattgttgtcaccactctatggggaatcaatgagaatggtggcagaaaagtactctgctgaatggtgaggcagatataaatctggcctaagtgaaacaaaaaactctccatttttaactacactttactggctccaggactggacattttcaggggtagtatagggaaggactaaggatatcgagggttcttggatgaaataatacatagattgttggtcctggctgagtgcagaaacaagggaaaacagcagggcttgaaagcttaggagaaaatggagggaggcaagaggttggaggacttagtggattcatggagaacaaatagaaatacggaagttagaaggagagtgataagaggcaaggcaaagtaggtgatgaaattacccaaagtatgactctgggattgggttgctgaagaagagataataaattctttaaagtaagtaagagtggtgaagtgcttatcccatgtgacttattagagacagaatctgaaatataatttgggtttacattatgaaatttagtgcattatgccataagaatgctgtgtctcctaatccattatgttcgttaaggtggagctttacatgtgtcttgatatctgagtataatcttttgcaataaattacagaagttgtctcatcactaatttggggtgtgctgattttgtttctaagtttataaaatgaaagtcttgatttttgttggttaaatattttgaaaaattgcagttcaagagcaaagttatgttttactcatcagttttttgaatgaaaaattatgtgaacgagataacttttgtatgaatttttaatttttagtaaagttacttaagttatgtttattctccaaaatattatcagtcacatttatttagtgctcaagactaaataagaattttagacagattctcgctctgtcgcccaggctggagtgcagtggcgtgatctcggctcactgcaagctctgcctcctgggttcacgccattctcctgcctcagcctcccaagtagctgcaactacaggcgcccaccaccatgcccggctaattttttcgtattttagtagagacagggtttcaccgtgttagccaggatggtcttgatatcctgacctcgtgatctgcctgcctcggcctcctagagtgctgggattacaggcgtgagccacggtgcctggccaatttttttaaaattatgaaactaggaaacattgttctattaaaaatatttttctctatctattcacagtaacactgaagaatgcagtttacttacatctttttctgtttgacagaagacagttattagtaagtataattattagataaagtatacttattttccatgtttaaaatatgaaaaatatgcaatataggttggtactaagaggggaaatctgcttctgatcaaaattttattttaaatatcatttttatttcttttgtcctaagttatatactttttcttctattacttattgcaaagttactttaaaagaaaacaaaatcaaagaaagcaatcaaccaagattttaaaaataataatagcagaatctctcctcaattctttcctcttctccactccatcttgccttcacagctttttttgtttccaaaggtagtcaaaacattttagatatttatgccaaagggcatggatctgtgataccgtgggtcctgccaagctgaaggttttcctttggccaagataagttactgtggaaggaaagtaactcttccaatccacggttcttagaaaattatacttttatactttttaaattttaaatgaaatgccccacagctttcaatgcatacccagttcagagaatttgaatatcatccaacatgcttccacagtgatcccagtctgagaggactgtgttattatgtaaatgcatagcttgctttctaggtaataaatgataaaactcttcatacaggagaatttggtcttcggtgtatttctatatgtattgaaggtttgctgtgaaatcactctggaatctctcagctggtctgctccacagtatcctactggtcttgggctttgtatattaactttccagaactcatgctcactacagacttgctttagggcctctaaatatttgttgcttttgcatgccaagagttttatccttatttttggagacaggagaggatgtgagtgttgaattgtatttcaggttacccttgggacatcaaaatgaccaaggcagtgtctgctaagtatttgctgagactctgctatgattctttcaagtctaaagacagttatctgaatgatatccccgtgacagtggactcctgcacattcacagtcctggaaggagcctgtccacattggcattctggaagtccataaaagacaaacgcatatgcagtccccgagaaagcattgttgtaaacaaatctgcactagatggaaactctgttatgtggtgccggcatgcatggaagagtaagtccagaactacacctggaagttctttttactaaaagaacacacagttcttttttactttattatattgtattttattttattttgttttattatactttaagttctagggtacatgtgcacacatgcaggtttgttacatatgtatacgtgtgccatgttggtgtgctgcacccatcaactcatcatttacattacgtatatctcctaatgctatccctcccccctccccccatcccacaacaggccccggtgtgtgatgttccccgccctgtgtccaagtgttctcattgttcaattcccaccaatgattgagaacatgcggtgtttggttttctgtccttgtgatagtttgctcagaatgatggcttccagcttcatccatgtccctgcaaaggacatgaactcatcattttttatggctgcatagtattccatggtgtatatgtgccacattttcttaatccagtctatcattgatggacatctgggtttgttccaagtctttgctattgtgaatagtgctagaataaaatacatgtgcatgtgtctttatagtagcgtgatttataatcctttgggtatatacccagtaatgggatggctgggtcaaatggtatttctagttctagatccttgaggaattgccacactgtcttccacaatggttgaactaatttacactcccactaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagcgtctgttcatatcctttgcccactttttaatggggttgtttcatttcttcttgtaaattagtttaagttctttatagattctggatattagccctttgtcagatgggtagattgcaaaaattttctcccattctgtaggttgcctgttcactctgatggtagtttcttttgctgtgcagaagccctttagattaattcgatcccatttgtctattttggcttttgttgccattgcttttggtgttttagtctttgcccatgcctgtgtcctcaatggtattgcctaggttttcttctagggattttttttttttttttttttttgagacggagtctcgctctgtggctcaggctggagtgcagtggcgcgatctcgactcactgcaagctccgcctcctgggttcacgccattctcctgcctcagcctcccgagtagctgggactacaggcgcccgccatcacgcccggctaatttttttgtatttttttagtagagacggggtttctccgtgttagccaggatggtctcgatctcctgacctcgtgatccgcccgcctcggcctcccaaagtgctgggattacaagcgtgagccaccgcgcccggcctcttctagggattttatagttttaggtcttacatttaagtctttaatccatcttgaattaatttttgtataaggtgtaaggaagggatccagtttcagctttctacatatggttacccagttttcccagcaccatttattaaacagggaatcctttccccattccttgtttttgtcaggtttgtcaaagatcagatggttgtagatgtatggtgttatttctgaggcctctgttctgttccattggtctatatatttgttttcgtaccagtaccatgttgttttcgttactgtagccttgtagtatactttgaagttaggtagcatgatagcatcacaattctatacacatttcaggaatgatttttttaaagagacacctcaattcttaatgatttttaaatttttgtaaaataatcaaatgcaaccaatggactgattgaataaatctacttttccctttttgttgatgggccctaaatttccaagtcttctgtgtataaggtgggcttaattttacaaatagtcattttgaagttaaaataacttgttttctgtatacccaattttaaaattcagaatgccatatcagccactttatggataatttctcacatacttctttctctgaatatgagaattttaaaaatttatgcaaaaatgtttcaacttacaatggcatattttaatataacatcttcaatttcaactttttccttttggatatacttttatagaaaggaattcagtatttattaaaccactattttcttcatctattggcagtgtgtttaaggaattcagtttataccttgtgggaatctttttcagataaactgtatatcaagtagttttgtggtgtttgaaggaactttttggcattcagggccatttcttgtgctgtacaaagcagcccttagtgctttctggagagcagactacttaaaattcatatgaacacattcgatgtgatgtgtatgtttagaatcactattgaaatatttctctatttaattggggtggttcatgctaattcacatggcggacattggcagctattttcagtctaccaattttttcttcgggggacatagtaaaatctctgcttccataaatgtttccactttctgaatgcagcagttttcccttcttcttctagctctttcttagtgggcagagagaacaggaaatgctagttgttgcaatgcaagcctggcaggcaagcacacctctcttccccaggaactgagtaagccacgatgctcaactccagtgactgttgaatttcaacagctgcaccctctctttttacccctggtgtcacatagagcatatgctcttggacattcaggaaatcaagtattgcttccattctggccatggtgctagaaatgcagggttttatctctttacctcaaccatttctgtctcctccctcagctcctaggaagctgctgactcacccttttcttgacaagtccttctgggtagtcttcctggatagcatctgagatgaaccccaaactggcacactttctatctctttctgtctgccacatctggaatcacaataaagaggacactactggtaaggacttcaaatgcatgtcaaatggtcagagccatgggctctaggaacaggtgccagcaagtcacaacaaagggttaaatgagaccaatctgcccactccacagtgggcacctctggactctgggtggatctgaggactcttctttggtctgaatatgttggaaacttatttgccagtgaaacagttttgagacatgaaacctttaagaaggcagagccctcataagtggactaacaccattatcgtggaagtgggttcattattaagagagtaggcttgttataaaagcaagttcagcctcctcttgctcttgctcttgacctcttttgccgttccactttctgtcatgacataatgcagcatgaaggcccttgtcagatgtcggcatcatgctcttggacttccagcctccagaaccatgaaccacataaacttctgttcatcataaattacccagtctgtggtactctgttacagcagcataaaacagactaacacagacccatcatctcctgacacagatataaagtgaatccctagcaggcatctttgtccctcagaaaagtcctggaggccaagtagtggaacagcagcataccaatatctttcccacaaaaaacctttctaatttcgtgtccaatatttctaaaagaatggaggcaagtggtcttccgagggtccccaaattattcccagccgcctccttggcaaggtctgctttgatggattcacagattgttctgcaatatgagtagcattgacagttactatctttgggcctcagtcaaaacagagacagagaatacccatttaacaggcactccaacttaggtatccacagaacgtatagttttgttattctctatcatgggcctgctcttgccaatgtttcagcagatagctgcgtagtttagaatttctagttaataatatttcagtttcaactgtctcccttcagtttaatatggggtgtatttaaaataaatacaactccctattagatattaaaggattgttttggaacaactgagtcctttcagataaatcttcaatactctacttttctctcacttctctcactcttttttgtttgtttttttgtttgtttgtttgtttgtttgagacagagtctcactctgtcacccaggctggagtgcaatggtgtgaccttggctcactgcaacctccgcttcttgggtttaagtgattctcatgcctcaatctctggagtagctgggattacaggcatgtgtcaccacacctggctaattttttttggtagtttttgtagagacacagcccaccttggcctcccaaagtgctgaaattacaggtgtaagccactgcgcccagactcactctcctttacttctccaggttggtggctgtgtctatgaggagtaccctttctatgtctgcaggaggagagtgggtccttgcatccacacagcagcctggagtgtcactctggacactctcttgcctcagcctcccgagaagctgggactacaggcatgtgccaccacacccagctaatttttgtatttttagtagagacggggtttcactatgttggccaggatggtcttgatctcttgacctcgtgatctgcctgcctcggcctcccaaagtgctgggattacaggcgtgagccactgtgcctggctgatagtttcttatactgtgaagaagctctttagttcaattagatcccatttgttaatttgtgctttgttgcaattgctttttgtgtttttgttatgaaatctttgccacttcctatgtccagaatggtatttcctaggttattttccagggtttttatagttttgggttttatatttaaggcgttaatccattttgagttgatttttgtgtatgctgtaaagaaggaatccagtttcagtcttctacatgtggctagccagttatcctagcaccatttattgaaataagaagtcttttctccattgcttgtttctgtcatatttgtcaaaggtcagatgatttagatgtctggtcttatttctggattatctatttggttctgttggtctatgtgtctgtttttgtaccagtatcatgctgttttagttactgtagccttgtagtatagtttgaagtccggtaatgtgatgcctccagctttgttatttttgcttaggattgccttggctatttgggctctttttaaattgtgtagttaagtaatgttaagcacattcacctgaataatcttgccaaagtaaaactttataatcattgaacaacaattcccacttttcaactctccccaaccctggtaaccactattctatcttgtgtttcaataaattttgctactttaaataccttgtaaaagtggaatcatacagtatttgcctttttgtaagtgacttatttcatttagcccagagtcttcgaggttcatttatgttatagcatgtgaaataatttcctttgtttttaaggtagaataatatcacactgtgtgcctataccacattttgtttatccactcatctgctgatgaacgtttaggttgcttccaccttttggctgttgtgaatagtacagctatgaacgtaggtgtgaaagacctcaagatgctgtttttaattcttttgggtatatactcagaagtgagattgctagatcatatattcaattttttgaaaaaccactatagcttttgagccaatgtttcaacagatagctgaataagttagaatttacagtgaacaatattacagtttcttccagtttcaactgtctcccttcagtttaaatatggaatctatttaaaatacaccccccattcgattttaaatgattactttggaataactgagtctttttaggtaaatccttaatacttcactttccatagctgttgcaccattttacagtccccacagtgcacaagagtcccgatttctcgacattcttgtcaatagttgtgattttacttatttattttggtagtattcatctgaatgggagtaaggtgatatatcattgcattgcaattggttttgatttgcatttctctgataattagtcactaattattattgagcatcttatacttccgtgatgacgtgggaatttttcttcattgtacaacagatatcattatagtggcgtagttctacactctacacaattttttctaacactacacaaaagcaaacactaaatctaacttccaattgtcaggattactggtctactcctctacccacccataggctgattataaatctttgaaattaattacatctaaaatttttctttcctgtcaagtcactgttgacgaggttcctctgctcacattggcagtctctttctttctcatgattcttcaagtcgtcattttgttagaggccaagctttcactcatggactgaagttatattgtgtgctttttgcctgagtgtttaatcccttaatttacaagcggatgtaggagtgcatacccaggaggtgagggcaaagactcccgttgagtctttggaatctcaaatctgttaccgttttggcttgggacaacaaacatcctgtcagtctcaattgctgtataattgaaaagagaatgataacagttgtcctacatacatcataactctctttgaatcaatgataattaatccatgtgaaaagctttcaaaaacttgtaaaaatccctcataattatatggtgttttacaatttacaaagaactttcacatgcagatttctcacgtgatttttatgttttgagggcagagtgagaaattataaagtatctgtgtatatgccaataatgatgcctaatatcccccactttacatatttaaaagacctttaaaattatggcttttcctagttttcacagcacattaaaaaagccaataccactacacaggtgtgtagtttctggtcttgtgcactgaccatttcctacaccatctttttgtatgctctctagcttccgtagttgttactcgagtagaagagtactgaaaggccacgtagaatatacagcttggtttcatcccactgataaaaatctacttttaacatacatgttaaaataatcaagcctgactaaattatttttgtattttttccattttacctgttatcaactttttaattaagcaatggggccatggtaggcagggtattccctagaacttgtgaatatgttaccctacatgacagaaggactttcagatgtaattaaacttaatgacgttgagttagagagagggtcctgcccagtggaatcacaagggtccttaaaggtataagaaggagtcagaggacagagtcagaaggagacgtgctgatgtgagaatggtcagagagatacaaccttcctgtctttgaagatggaggaaaggggccttgagccaaggattgttgttggcctttagaaactggaaaatgcaagaaaatcaagtctccctaaagcccctagaagggaacacagtccaactaattcatttattttagcccaggagatccctgttgggcttccgacttacagtactggaagataatacattcctggtggtttgtgtcacaaggtctgtagtactttgttccagtatcagtagaaaaccggtagaaggggaattcacgtaaatatcattacacacagaaataattacttattattcttttgttctcaaatcctaccttgtaaacaaaatgaatttttgtttttcggggcttttgtactaattcttatgaatccactgatattttgttttttctgtcgtctccctcaggaacccgaaaggaagaagctatacgactggggacacatgtcttagaagcacactcattagataaagtgtcgcatactctttgataaggtaaggctccctggacgagatgttttacaggtaccatgagctcagtgaattgcttttggaaagacactcagcggagtgggcaccacgaggttaggagaagcagcttctgctcgtcataactttggcaaatgtttacacatcagtaatgaaaaatattctcttggcgatttcaggcttgttactatggatgttgtttgctaacattgactatttttcctaactgcttatagaaactccaggctgtcacccatctgttctctcatcaaagtagttttgggccagcaactatttcagacatttctacagtttcagatgtctcactctgcctatgactgtatgttgtacttgaggactggacgcacagggtaaagtgcaaatagcaagcattcaggtccaactctcctccttctggttaacaatatgaaagaaagaggtagtatcggaattattttagttcaatgtagccattataaaatgtgtatatattttaaaacatcatgtggtacatgataaatatatacaacttttatttttcaataaaaaattataaaaaaagtcatcaaacctgatttctcatactacttttttggtaacactcatcacaccaaagacttattattttaaaatgttatttttcataattaatttcttattaattttataggctagattttaattgttatgtctaaatagtagtgtctggtacgtggtagataatcaatgtgacttgaataaatgaataagtctgttaacgacatacttctcatcactgtaacttatttttggtttaggactgataaaacattttttctctcaccccatattgctaaagatcaaatccttcttctttaagatgctaccataccattgttccattcatcaacgccaaatcattcctcgggcctgagaggagctgccatccttcacttcgtctttgggtcacttccaacctctgttctctgtgtgtctcttctggacttcctgggagaatagcctctctcatgatactcactttcttccacatcttcaatctctgcttcattgatagattatgctactcaatatagaaacaacatcttttttattttttaatgataaacattctccccctcaatcttttaacctactaatgcaggcaatctaatctaaagaatagcctgcaatgcctcctttcatcatttcccatttaatccagctttctggctgagtaattttgcagaaagccctttctcccatgtcacagatggaactttgcagtggcctattctgataaacatgtggcagtttacatgctatttgcatttgaagctgtttatcactccctccttctgagtactttcttcttggtgggcttttatgatagtaattgctatcctactgctgagtttctgaccactgcttgtcagacactttattatgctccctttcctttgcccatacttgcaaagttagatttccacatatgcctttcccgtcttcttattccatgagatttatctaagtgatttcatccattgctatgggttcaactgctgctaatatgttctttactcccaactctctttctacagcttcacatatttaactgccttttagggaatcaccaaaaggcaattccatcttaacatacacaaaactgaacttatgatccttaagtatgaggccagttctttcttatgcattttctaaatcagtgagtgatactatctcttgtcctgttgtcctgggcagaattgcaggaggtgaccgctttctctaccctccctataaaaattaccatctctcgtttaccaacctcccaataccccaatcattagtatctttttaagaaatgattttctgttgtttaacattttttatatgctattacctatatggttttcctcctgaaatgggatattgggtaagagggtaccagatggaggtcacatagacctacagtttattcaaaggggacatctatggagcaaaggcaaaatggagaacccagtgcagccaaacagctactcaaaggtctgagcagagatacagaaatgacacaggagataacagaaagagagagacatatcaagtgggttttgagtgtaggcaaaaccacatttacccgtagctctggagaacccactggcactgttttgagactgttgcagcctgcaagggagggcggacactgagttcagacacacacaccctccgaccagctcccaaatgtctgctgacgtttacaactttgcttcctgctttcctacctggtcttagccttttgatacacaccctcccactgctatcagagtaagatttgagctaagtacataatctggccctgccagattatgacattagttggagaatagataggtcaatgggacctgagatacattttagaaaaatattaatatgtatgccttatgtatagtgtgcagctggcattttaaacacgtggaaaatgatgaaaaatttaataaaccatgagaggaaattggataaatatttccgatacacacacacatcagattcccttttttatgtcacatgcaaaactaaaataatatttgaatggcttaatcagtgaaatatttttctaaattaactaacataccggaaaatatttgacttatctcaaaccaaatatgtatttttattgtatagggttttttcttttttaaaaaatttcagcttgcaatttagatataggaggtacatgggcagatttgttacaatggactattgcatgatgctgtggtttgaagtacgtttcccatcaccctggtagtgagcatagttcctgataggtagtcttttttaacctaacctccctccctccctccctccaccgtctagtagtccacagtgtctattgtgtctcatatttatgtccatacatgctcaatgcttagcttccatttataagtgagaatatgtggtatttggttttctgtttctgcattcatttgcttagatcgccccagctccatctatgttgctgcaaagaatgtgattttattcttttttatggcgtatagtatttcatggtgtttatgtaccacattttctttgtccaatttcctactgatggtcgcctgtgtggattccatgtctttgctattgtgaatagtgatgcagtggacatctgagtgtaaatgtgtttttggcagaatgatttattttcttttgagtgtatacccagtaatgggattgctgagtcaaatggtagctttgttttaagttttgagaaatctccagactgcttcctcagtggattggtctaatttacattcccactaacagcgtataagctttcccttttctctgcaatgttgccagcatctgtttttttgactttttataatagccattctgactggtatgagatggtatctcattgtggttttgatttggatttctctgatgattagcgatgctgagcgttttttcacacatttgatgtatgtcttctttgagaaatgtctgttcatgtctttgcccatcttttaatggggttaattgggttttgtttgttcaactgtttaagttccctatagattctggatattaggcctttgtcaggtgcatactttgcgaatatctcctcccattccctagactgcctgtttactgtgctgatttttactctctgtttattttgctatgtaaaagttctggagtttaattaggtcccacttgtcccgtttttgtttttgttgcaagtgcttttggggacttagctaaaaattatttgccaaggctgatgtccagaagaatgtttcctaggttgccttccagaatttttatagtttgaggtcttacatttaaatctttaatgtattttcagttaatttttgtatgaggtgaaacggaggggtccagtttcattctgctacatatggctagccagttatcccagctgtgtttattgaatagggagttctttcccattgcttgtttttgttggccttgtcaaagatcagatggttgttggtatgtagctttatttgtttgttttctattcttttgcattggtctatgtgtctgtttctgtaacagcaccatgctgttttggttactgtggctttatagtatagtatgaggttggaaagagtgatgcctctggcattgttctttttgcttaggctttctttggctgttcaggctctttttggttcaatacaaattttagagtaattttctaattttagtaaattttctaaagtaaatgttctaatcctgtgaagaatgacgttggtaatttgataggtatagcattgaatctgtaaagtgctttgagcaatacggccatttttacaatagtggttttggtactgaaacaccaggtgctcagtctaggtcctgctgcttgctgcacagaaagccaatgactgagacagcaagtattgccaaggaagaagctttaatccggtgctgcagcagaggaggtgggaactcagtctcaaatccatctctctgacctactaaaaccagggatttatataacaaggaaggaatgtaacattgtgtaagaaaacaggaactagggaggtgtcaggaagcaatcgcgatgaatgaggggtacaacatctcattgtctggatgtgatgatctactgagtttcagttctttgacactttttgtgagaggcctgaaggtcatttcctcaggaaggaactcagataaaacaaatataagtttcaagctttaagaccagaagggtcaatttctatgtttattaaaaagaaaaaaactgttagactgggcgtggtggctcatgcctgtaatcccagcactttgggaggctgaggcgggcagatcacgaggtcaagagattgagaccatcctggccaacatggtgaagcatcatgtctactaaaaatacaaaaattagccaggcatggtggcacatgcctgtaatcccagctacttgggaggctgaggcaggagaattgcttgaacctgggaggcggagggtgcagtgaactgagattgcaccactgcactccagcctggtgacagagcgatactccatctcaaaaacaaaaaccaaaaaccaaaaaaacaaaaaaaaaaccaaacaccagaataaaactgtctatgggacaattgggtcagctttagtttttccaatccttgagcatgggatatttttccatttatttgtgtcgtctcatctcttatttctttcagcagtgttttgtgcttctcgtagagatcgttcatctccttggttagctgtatgcctataggtattttattttctttgtggctgttgtaagtgggactgtgttcttgatttcaccctcagcctggatgctgttggtgaaatatgtatttttaaaaaagaaaagcaaaaaaaaaaaatagatagacttgactaaacaaacattattataaacaagaatgagtgtcaatattcttttccataaggtactcttacaaatcagtgtaaagaattataatttctctatttaaaaaaggagatagcattgccagttcacaaattgtatataagtggcctatgaatgcaaaaacctcaattgcataagtaataaaaaagtctaaataaagtgatattacaaattgtataaaagtggcctataaatgcaaaaaccttaattgcataagtaataaaaaaagtctaaataaagtgatattattttctactgatacaattgatggggagaaaaaccaaaataaagtgaacagaagaaaatggggaaaaagggagccttttagactgctagtgggagggtaactttgtataaactattagaatacaatttgtcaatccgtgttacaatcaaattgttcattcactttgtaacaacagttctatttctaggaaataattatagatggcaactatttctatataaagcttttcattacaatgttaaatatgataaaattggggatactcaagtggtcactaataggagcatgactaaataaactttggtagtgacagtgaatagaataccatgcatctattagaaatgccttttagaaaataaagtcaatggcatggggatacagacataatttgtaaagcagtataactcaaatttgtagaaagaaattacaggacaaagactggtactgattcaaaatggtgcctggctacgacgggcctttgtccccagaattaagcctggagaattgtcctcgaagtaaagcaggtgctctacgtgtagaaagctcctggtgcggatgctggactctgagagaaggctgagcacagccttgggtaatgcagaacttcctcaaaaggcaaggaggcaaaaataaaacaagtgaagagcaactctcttagaagaggaaatgcactcaagcccttgggccacagagaaaagtgctcctgaaactggaaactctatggtctcccagcctccagcctgcctgctcttcagtcagtcaccctacaggtgacaccccctgcattccccactctcattttcagagagctgctgccgggaccctcattctgggaatggactatgaggaaggagacctacatagttgtcaaggaaacctatgccagttacatatgccatacattttaatcgcttagttatcaatgtgacaggtagggagaaaacaccaaatgcttgaggaaaaccaggggtatgaaagagaagcattaagattactttttaatggaaatgtatatattcacctaggctattcttccttacccaagttgaaactgaatagtatgacctaaacgtacatttcgtgtgctgggaagaaaaagcaactgataaccccctttcccgtaggtttcctgtcattaatttgctcaccagtgcaaccccattcaggcccccaagctagtgccatcttgtgtgcacaaggctggggcaattggattcataagaagttttgtccatgaggaattttcagtctaatgccaagtaattgacaatgaaaatgtttcctggtttccatccaaatatttattaatacagcaaaaatgtaggatttgtaggatttatgtatcttccaactatctccactactgcaggacacagacaccatctataaatctcacattgtaaccactaacacttatctttgttattgtcacctggaatcttttatgccaaaataagagtcttaaaagaatgaagccctgcaatttcactgtccaacaacagaggttttacctgataaatcgtcttctcgtctgacagagtgggccacagaaacatctctgacagctgttgcatgatggagtgggagcaaggtcacttcctgcaaatgttagggttcttcagaatccttcaggcgttggaggaataattgaactcaacaggcaatcagtcacgtctgaaacatgtgaaatatacctaaggacccgaggtcagggttgagtgtccaaattcaaccagttattcacacggtctgaaaatgaaaatgtttcatttcagagaagtttatatggagtccttgacagaatgttgaatatgaaatagattttttttctgtcttcctttgaaaatctttgtggataaagcttaacatggtgcattagaatcttaggagtaaaatatccctcacaaaatttgatatcttatctgattagttaatacagacatattacatttttcaactaattttttttcttaagaagaattctttcagaaacggagaagcatgtagtaacatactgattttaaggaacctatgctaacaattttaagtagtaaaacttaaaactaaacttaagaagtaataaaaaggtgataataggataattactatttggcatcctactaagatatttagttggcaatttaattttaaattacctggttttctctgatattcacatattattaaatgcaatttcatttaagctgctctactaagtgttagggaaatatgaaaattgaaagtgtgaccttgttgtccagtaaagtaattttatcgaatttggtagactcttaattgtccctaagtattcattttccctttctttttttttttttattgtagcttttcttttgaaatatgcgttgcctcccagacattgcaaaatggtatagtgagttctggtgtattcttttttttttttttttttttttttttttggagagacggacttgttctgtctctcaggctggagggcagtggtgtgatcatggctcactgttgcctcgacctcccaggaacaagcgatcctcttgcctcaacctcctgagtagctagaactacaatcacccctcaccatgcccagctaatttttaaattttttgtagagatgaggtccgctatgttgcccaggctgatttagaactcctggcctcaagggatcctcctgctttggtttcccaaagcgctgggattcaggcatgagccactgtgcccagacttaattctggcgtattcttaagccagtgtcccctaatgaaaatatcttccaggacctcagtgcatggtccaaatgaggaagctgttaagaggtacaatactattaacacatgtacatacagatttcaacagcatttaagttcagttttttctttctgtcttttgttttgtgtttatagttctttttctgtcttcctttgaaaatctttctggataaagatgtttccacagatttctgtagatgtgttcagccatcaccacccagtcccagttagaatcagggtacagaactgcttcatcagtctcatgagaaggtgtgactgaaaggagcagtgcaaagatgctcctttgtcctttcagtcacgctttctccctgactctgacctttggcaccagctgttaggtcttcacactctaattttacactttaagaaaggtatgtaagggcagggtgcagtggctcacacctgtaatcccagcactttgggaggccaaggtgggcggatcacgaggtcaggagatcgagaccatcctggctaacacggtgaaaccccgtctctactaaaaaaagtacaaaaaattagccaggcatggtggtgggcgcctgtagtcccagctactcgggaggctgaggcaggagaatggcttgaacccaggaggtggagcttgcagtgagctgagatcgcaccactgcactccagcctgggtgacagagtgacactctgtctcaaaaacaaaaaaaaaaaagaatggtacgtaagtagaataatgtaggtagcaccattttgagattgcttttttttcattcatcataaagccctacaaatccacctaagctgttgcctgcattgatagtttgtttctttgttttgtgtcacagtttgtctatttattcacaggttgaaggatgtttgagtggtttcaagtcgtgggctgctacacatgaagcagcaatgaacatctgtgttcacattcctgtgtgactgtgtgtttcacttctgtagcataaatacccaggaggcctggattgcattgcaaatatgtttttaactttgtaggaaacagccataccaccttccacaatggttatgctgttttccatttccatcagcagtgcatgagaaagcctgctgctctgcgtgcttgtcagcacacggtattgtcagtatttttattttagccacttattaggtgtgcattgatgtctcattgtagctttaatttgcatttccctaatggctaatgatggtgaacatctttttatgtgcttatttgctatctctataccttccttgatgaggtgtcaacaaatgttttgcctgttttcttgttgttgaggttgcagcattctttatatggtctggataaaagttctttcttaggtatgtgatttgtaaatatttcttccaggcaatagctaactttttatcctcctaacaagccctacttagaactgaagtttgaaagtttgatgaagtccatattaccaatttttttctttcttagacatgacaactttttgtctaactcttgcacaggaagatttttttcctgtgttttcttctagaaatgttgtagtttcacactttacatttagatctatgatctattttgagttaatttttatagaaagtgtgaagtttaggtctagctttttgtttgtgtgttttcttttttggcctacagtgtttaattttcccaacatcttttgttgcaaattctaatcttcctctatgggattgctttgcattttcattttaaaaaattaagttgactgcacctatgcaggtctatgtccagttcctttatcctgtgccattgatccgttcctctgcccaagccacactgtgaggctgtcttcccaagctcctccctttccaggatctccccggccacagcttctcctttcctcgttttgatcatctagccagaaagctgggcttttagttactcagctctgctgtgcacatcctgcaactgcggctgctccaagcaggagatacagagaaaaagaagccagtcttttcctcaccaccttagaaagagaggtccctgccttgaagctcacgctccccgcacctgctgccttcacagtccttaccctgcagagcgcggcttgagagaggagaggggcgagcttgggatggtggatggccctcccagctctgagctttgggggccagagctaaaagagaggctgctgtctccaagttgccttcaatccaagctggagaattctgcagacaaatagggcgctttcctccactttggtagtacttcaaaatcttgtcttcttcctcaatgcgtcaactaccacccagttttcagagccctccaacctcttttccctgcatttcttcctggcactggatccctaagtactcagtttaatccatacattgcccttatcatttctttttttctttttctttttctttttcttttttttttttttgagacagagtttcactctgtctcttaagctggagtgcaatggtgcaatcttggctcactgcaaactcagcctcccgagttcaagaggttctcctgcctcagcctcccgagtaactgcgattacaggcacctgccaccatgcccagctaacttttttttttttttttgtagttttattagagatggggttttgccacgttggccaggctggtctcgaactcctgaccttaggtgatccatctgcctcggcctcccaaagtgctgggattacaggtgtgagccaccatgcccagcccgcccttgccatttccatcatctgtctttcacactggatcttttttcagttgttccaataaaccaagtggtaaaaatttgaaaagtgaatgtgagtaataggaccaaatttaaaaagttatagaattttagggttggagaggaacgtgaaagagttataatcaccctttcaagccaccaagctgagatgaaatgccttgccctaagtcactcttagccctctgatcttcctacgatgtcatgcgactttcacatagaaactaaaaggacttaccattaatttctcctctttcatttacacatatgaatttttttaaaagtctttctcatatcttgactaagttatactcacaaaacctacccatttttctgctgaatttattcttgaacttgaatacagtctcatgtggaaacagtaataataccaaaattgcaaataatctttatatctgacattgctcttagttaattctgttgctagtttggaaagttttttttttttaaaaaagaatgtttaaacatcattacgtttaaaacattttaaagcctgagtacgagttttaaatcagaatcactgacttccctcccttacacctcattattacaaaccttgatttgaaagccgtatttcctacaaagagtcaaacgagaaaaaacatactcctgtgtgaaaagaaatataccaatgtaccaaatccttatagtttctcttccccaacctgtgaccaatgttcaccctttggtgccagactcatctgttttacacacacacacacacacacgcacacacacacaccccgaaaacttgatgtaaaatgtaaataattcatattagacataataataaggaaaggaaagcaaatagcaaatgtgcctttgttgttaggagtgaagatgcaggttcagaattgtctgtgctgagtaaggataaggtcttaatatctgagaaaaggggtctgaatcctgaggaggatatacagaaagtggccttttgaattagactatttgggcaaatgtgcagaatgatggcgactgactgggcagaactggcgtatggcaccaggttgtagcaatggagatgaaataaaagggcctgatccctaaaagaactttaaaggaagaaacaacaggacccactaacaaatggaaaataagtgatgaaggaagataatcacaataatatgtagtgaatctgagtcttttggccagggaacttgtgacaaatatagaagtaccaaaaaaaaaaaaatagagacattcgaaagatggatatgggatggaaaaaatgaattgttcaggatgtgctgagcttgaaatatcaaggtcatattcaacagaaaaagaaatattgtgaaggggcccagatgtgagggtagggcaaaaaatgatattagtagaaaagtcatttgagtaaagaaagtggatatgttaatagggaaaacagagtgcttggcccagggcagaccctgtaagattcccatgagtaaggatcagcaggtcaaagatttaccagtaagaagacagaggccaatgagacaaagcaagaaagcccagagtccagagagcatgagggagtcctgtttcagaaggggagggtgactagccggaagacttggagaaagtggaagatgaagaaaatcctttgagcgggggagcactgtctggcttggaagatggtcctaggagataggtggggaaatggccagatttggggaggaagaatactggggaatgtgaaaggtctgtgcctagagaacaatgcgtcaggacatggtgatggaatgaagggattggacagcgctgaacattttaggagacagaaggaaaagaagagtgaagtgagacagaaagacatggaggatgtgaaagaaaatgtgaggatttatattcaaaataccaaaaagctttctaattcctagacttgcccccggctagagtgggctatctgggtgaagagtttatacagatatccccatatacactatttattctacttagataacactctagagacactatgtcctgttttcttgaaagactcataccaatggtgacatttcagatcttctaaggaagtttattttagcttcaaaataacacgggtggcacgggggaagtatttttagcctcaaggagcgttttaggccaggcacagtggctcaggcctgtaatcccagcactttgtgaggctgaggtgggaggatcatgaggtcaggagttcgagaccagcctggccaacatagtgaaaccccatctctactaaagatacaaaaattagctgggcttggtcgtgtacacctgtaatcccagctactcaggagactggggcaggagaatcacttgaacccggaaggtggaggttgcagtgatctgagattatgccactgcactccagcctggttgacagagcgagactctgtcaaaaaaaaaaaaaaaaaagagaggactttagtacttctgaaactcctctgtgtagctcttcgttcaagcaatcctaactcagaagtacaagaaggataatattcttgtgtgtgctctgaagctatttagtagcatcagaaaggtggagaataagtagcttataaaacattgacagctcttcaaattggactaacaggaaatctccaggcattttattcataattttggaagaaatgcaataacaaagatttaatgggtcccatattgtgaaacataattgatctagaataagtactattcttattcctatagacaatcatactctgagattttggtcaagtatcagttgattgttaattatctacgtgtttgaaatatatgaaatttaatagagaggccataagtcacatccaagaagtactaagagaaagcaccactgcaaaatcttggtaaattcagaaaataataacaaatctcataatgaaataaatattttattgggattataagacctaccatccaaagaaccattaggaactttacaataactcattaatttatatgggaaatatgacagaaagcaatttctgcttttacttcttttcttctttacttctttcccttagtgtgttttgcatgtgtgtttgtgtttccttgaatcgttgcttaatccaagaagctttcaattgacatcccatgtcagacgggaatgccactgtatcacttattgatttcaacagtggtagtttactcctggaaactaaaaccgttaggtgtttctaaaatgtatgcacacacacacacacacacaaacagagtttaagggttaagtatttatcttcctacctgtatttttcagaagaaagaagaaaaggaggatatgcttctgtactagagactactctttattagaaaagcacaggaacaattctcaacctgaatattttcaataaatgccttggtgaaaattactgaagtggtgctacaaaattgccttgtcttatttttgaggacatgtggaaagcctttctacaacttttagatatatgtaataaagctgaacattcttcacatcatccaaacttattagagagcttaaagtgtaatagtcaaatcgctagcattggttagtttgaatgaatagtccttttaagacttttttttttttttgagatggagtctcgctctgttgcccaggctggagtgcagtggtgcgatcttggctcactgcaagctccacctcccgggttcatgccattctcctgcctcagcctctggagtagctgggaccacaggcacccaccaccatgcctggctaattttttgtatttttagtagagacggggtttcaccgtgttagccaggatggtctcgatctcctgacctcgtgatcctcccgcctccacgtcccaaagtgctgggattacaggcatgagccactgcgcccagccaagactttttaaaatgcttccttcttcatggatctgggctcctgagtgagtgtgctgagtgaatcatgcatggtagcagacacctttcggaatccggcttcagtagacgtgagggtaactccagtgctcagaaaaggtcccttagcagctggacttgctcaaggtgactggatgctcgtcataagatttccaggttgggtctgagttatgtcaagtactagttggaattgatttattgctgtcttgctcacaagccaggagcacacttctgaagttgccaagagtgtgaaaaagcagatatccaaattgtgaagtgagtggtttcctacattaactcgaattgattttgttcttcctaatgctgataaggattattttggagtagaatacagtagccccctcttatccatggggatacattccaagaccctcagtaattgtctgaagtcccggacagtattgaaccctacatatactatgttttttcttatgcatacatgtctttaataaagtttaatttacaaattaggcacagtaggagactcacagtatctaataaattggacgattataaaaaaactgtaataaaattatgtgaatgtggtctccttctctccaagtatactatagtgctgtaatcacctattttcagcccatgctgacttctagtaactgaaacctcaaaaagcaaaactccagataaggggtttcatttactgtaataaaatgaaaattctgtaaacatgtttagttgaaaatatcttacagacatacataattcagtggaagcgatagtgatatgtttcagaaattcagattcaagatttcagaaattcagtttcaaggttcaaggctcctctgacaattgaatgacttagtttttcaaatataatcaagattctgccttgaattatatataatatatattattattatttccatatataatttatggaaaagttataaaattaatataaacatttgaaatactgtcttttggctcactttgaaaagatttccagtttgcttctaaatgaataacaaatttgaaaggccaagtgatttaaggcaggtacatcactacttagcaatacgatttgttcaagcaggtgaaaagtatgcaagaatcaaaatgctctttgcaaaaggagcttcaattttcatcaggaaaacccagtttgtgtcagagggtgaaacttgcttgactagatctgttcactgaagccattgaacaacttccgatgttcttgctctctcccatttacgatgctgaactttacagagacagactgtttgaagccttcctaattattcccattcttagccaagaaggattactaaagctcagcctctattgtaattcttaaacttctcagtgcaaattattaatatatggcaatctaaaatgcctttctctggctttatgacctgattattatttcgagtctctctagcagtgaacttgaggatcatgcaaacatgttctatgggaacatcactgtgtagctgaataatttgttttttagtaagctagctcaaatttatcatcagtcatgaaaatgttttatcaatgctcttccataaagcagacatattattttactagtttcagtttagccctgacagaaacctgatcgggaatactattattaagccacaaatacctgttttaaaatatgttgtcttatgctatttcattgtattgtattaataattcatgtaatatttcctttggttttattgtcttctgtgttataattaaaactgaaataatttgggaaatgtaatgtatatagcacacatctaaagttcagagtgagaataaaactacaactattttatctattgcaatagctcaaatagtagagtttaactataatacttggtatacatatcaaacaaggtatctatacatacattattttaattttactcctccctcattttctctccacgtcccatcacataaatatgcacaaatttaactggccagaggtgacctacattctctacatgcagtgtccatgatgaagatagcaactgtatttgctaaggttttcacagttcataacagtgaaataaaatgtagctatggacattcattgattaatctaatatttattgaaggtgtatttgttagattccgtgatacaatgatgaacaagtcattgtgtaatcatgaagagcttctagccaagtgggtaaaaagataaggaaatcatcccaattagtgagataaactacaagatagggaatcattccgtgtgttaccagcacattctacccacgctgtatttttcagggaaaggtggtgtacattacctgatgtctaaataggaggtaaaagcataaggtgctgggagacaaaggagttgtagattacctgatatccaaataggaggaaatagcataaggtcatggaagagagaggggtgtagattacctgatgtccaaataggaggtaatagcgtaaggtcctgggagacaaaggtgttgtagattacctgatgtccaaataggaggaaatagcataaggtgctggaagagagagggctttagattacccgatgtccagataggaggtagtagcataaggtcctggaagagagagggttgtagattacatgatgtccaaataggaggtaacagcgtaaggtcctggaagacaaaggtgttgtagattacctgatgtccaaataggacgaaatagcataaggtcatggaagagagagcgttgtagattacctgatgtccaaataggagggaataccataaggtcctggaagacaaaggtgttgtagattacctgatgtccagataggaggtaatagcataaggtcctcgaacacaaaggtgttgtagattacctgatgtccaaataggaggtaatagcataaggtcctggaagacaaaggtgttgtaaattacccgatgtccaaataggaggtaatagtataaggtcttggaagacaaaggtgttgtagattgcctgatgtccaaagaggagggaatagcataaagtcctggaagacaaaggtgttattatattacctgatgtccaaataggaggtaatagcataaggtcctagaagacaaaggtattgtagattacctgatgtccaaataggaggtaatagcataaggtcctggaagacaaaggtcttgtagactacctgatgtccaaataggatgtaatcgcataaggttctggaacagagagggttgcatattacctgatgtccaaatagcaggtaagagcataaggtccgggaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcaaataggaggaaatagcataaagtcatggaagagagagggttgtagattacatgatgttctaatagaaggtaacagcataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtattgtagattacctgatgtccaaataggaggcaacagcataaggtcctcaaagacaaacttgttgtagattacctgatgtccaaataggagggaatagcataagctcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatatcataaggtgctggaagagagagggcttaagataacctgatgtccaagtaggaggtaatagcataaggtcctggaagagagagggttgtagattacatgatgttctaatagaaggtaacaggataaggtcctggaaggcaaaggtattgtagattacctgatgtccaaataggaggaaatagcataaagtcatggaagagagagggttgtagattacctgatgtccaaataggagataatagcataaagtccttgaacacaaaggtgttgtagattacctgatgtccaaataggaggtaatagcataaagtcctggaagacaaaggtgttgtagattacctgatgtccaaataggaggcaacagcataaggtcctcaaagacaaacttgttgtagattacctgatgtccaaataggagggaatagcataagatcctggaagataaaggttttgttagattacctgatatccaaataggagataatagcataaggtcctcgaagacaaaggtgttgtagattacctgatgtccaaataggaggtaatagcataaggtcctggaagacaaaggtgttgtagattacctgagttccaaataggagttaatagcataaggtcctggaagagagggcagtagattacctgatgtccaaataggaggtaatagcataaggtccttgtaagagagagggttgtagattacatgatttctaaatagggggtaatagcataatatcctggaagacaaaggtgttgcggattacctgatgtccaaataggaggaaatagcataaggtcctggaagaaagagggtagtacattaccggatgtccaaataggaagtaatagcataaggtcctggaagacaaaggtcttgtagactacctgatgtccaaataggaggtaatcacataaggttctggaacagagagggttgtatactacctgatgtccaaataggaagtaagagcataaggtccgggaagagagagggttgtagattatccggtgtccaagtaggcggtaatcgcataaggtcctggaagacagagggttgcagatgacctgatgtccaaatgggaggtaatagcataaggtcctggaagacaaaggtgttgtagattacctgaagtccaaataggaggtaatagcataaggtcctcgaaaacaaaggtgttggagattacctgatgtccaaatagcaggaaatagcataaggtcctggaagacaaaggtgttgtagattacttgatgtccaaataggaggtaatagcataaggtcctggaagacaaaggtgttgtagattacctgatgtctaaataggaggaaatagcataaggtcctggaggacaaaggtgttgtagattacatgatgtccaaataggacgtaatagcataaggtcctggaagacaaagttgttgtagattacctgatgtccaaataggaggtaatagaataaggtcctggaagagagggctgtaaattacctgatgtccaaataggaggtaatagaatcaggtcctggaggagagggctgtagattacctgatgtccaaataggaggtaatatcataaggtgctggaagagagagggcttaaaataacctgatgtccaagtaggaggtaatagcataaggtcttggaagagagaggtttgtagatatcatgatgttctaatagaaggtaacagcataaggtcctggaaggcaaaggtattgtagattacctgatgtccaaataggaggaaatagcataaagtcatggaagagagagggttgtagattacctgatgtccaaataggaggtaataccgtaaggtcctggaagacacaggtgttgtagattacctgatgtccaaataggaggcaatagcataaggtcctcaaagacaaagttgttgtagattacctgatgtccaaataggagggaatagcataaggtcctggaagatataggttttgttagattacctgatatccaaataggaggtaatagcataaggtcctcgaagacaaaggtgttgtagactacctgatgtccaaataggaggtaatagcataaggtcctggaagacaaaggtgttgtagattacctgatgtccaagtaggaggtaatagcataaggtgctggaagcgagagggctatagattacctgatatccaaataggaggtaataccataaggtcctggaagagagggttgtagattacgtgatgtccaattaggaggtaatagcataaggtccttgaagacaaaggtgttgtagattacgtgatgtccaaataggaggttatagcataaggtccgggaagacaaaggtgttgtagattacctgatgtccaaataggaggtaatagcataaggtgctggaagagagagggctgtagattacctgatatccaaataggaggtaatagcataaggtcctggaagacaaaggtgttgtagattacctgatgtccaaataggaggtaatagcataaggtgctggaagagagagggctgtagattacctgatatccaaataggaggtaatagcataaggtcctggaagagagggttgtagattacttgatgtccaaataggaggtaatagcataaggtcctggaagagagagggttgtagattacccgatgtccaataggaggtaatagcataagatcctgcaagagagagggttgtagatcatctgatgtccaaatattaggtaatagcataaggtcctgggatacaaaggtgttgtagattacctgatatccagataggaggaaatagcataagatcacggaagagagagggcagtagattacctgatgtccaaatagcaggtaatagcataatgtcctggaagagagggctgtagattacctggtgtccaaataggaggtaataggataaggtcattggagagagagggctgtagattacctgatgtccaagtaggaggtaatcacataaggtcctggaagagagagggttttatattacctcatgtccaaataggaggtaagagcataaggcccgggaagagagagggttgtagattatctgatgtgcaagtaggaggtaatcgcataaggtcctggaagagagagggttgtagatgacctgatgtccaaatgggaggtaatagcttaaggtcctggaagacaaaggtgttgtagattacctgaagtccaaacaggtggtaatagcataaggtcctcgaagacaaaggtgttgtagattacctgatttccaaataagaggtcatagcataaggtcctggaagtcaaaggtgttgtagattacctgatgtccaaataggaggtaatagcataaggttctggatgacaaagttgttgtaggttaccggatgtccaaataggaggtaatagaataaggtcctggaagagagggctgtagattacctcatgtccatataggaggtaatatcgtaaggtactggaagagagagggctttagattacccgatgtccaaataggaggtaatagcataaggtcctgaaagagagagggttgtagattacatgatgtccaaagaggaggtaatagcataagatcctggaagacaaaggtgttgtagattacctgatgtccaaataggaggaaatagcataaggccatggaagagagagcgttgtagattacctgatttctaaataggaggtaatactataagctccgggaagatacaggtgttgtagattaccttatgtccaaataggagttaatagcataaggtcctgcaagacaaaggttttgtagattacctgatgtccaaataggaggtaatagtataaggtcctggaagacaaagatgttttagaatacctgatgtccaagtaggaggtaatagcataaggtcctggaagacaaagatgttgtagattacctgatttccaaataggaggtagtagcagaaggtcctggaagacaaaggtgttttagattacctgatgtccaagtaggaggtactagcataaggtcctggaagacaaaggtgttgtagattacctgatttccaaataggaggtaatagcagaaggtcctggaagacaaaggtgttttagattacctgatgtccaagtaggaggtaatagcgtaaggtcctggaagacaaagttgttgtagattacctggtgtccaaataggaggtaatagcataaggtcctggaagacagaagtgttgtagattacctgatgtccaagtaggaggtaatagcataaggtcctggaagacaaaagtgttgtagattacctgatttccaaataggaggtaatagcagaaggtcccggaagacaaaagtgttttagattacctgatgtccaaataggaggtaatagaataaggtcctggaagagagggctgtagtttacctgatgtccaaatgggaggtaatatcataaggtgctggaaaagagagggctgtagattacctgatgtccaataggtggtaatagcataaagtcctggaagagagagggttgtagattacatgatgtccaaataggaggtaatagcataaggtcatggaagacaaaggtgttgtagattacgtgatgtgcaactgggaggtaatagcataaggtcctggaagacagagatgttgtagattacctgatgtccaaataggagctaatagcataaggtcctggaagagagtgtgtgttccagtcagaaggagctattggttcaggatagctgcaacatacatttagtcattatgatggaaaactgataatggagttaggcctgatgttgagatgtataattgaagaagagtgagaggatcacctttcaattcacaaagatcatcatagggccagtataaaagtattttagagacaagtaataatggaattagggaaaccagttcaggtaaaaaatgatgttgttctagattttggaggtgactgaagagaaaaagtacatataattcacttatagctctgcttatcctattacgggtatttctttctaatggagattacagatgttatttttaaaacactttgtgattctgaggaggcatttacttatgggtctagttgtatcattagtaacaatatatattgtgtttatcttaagcacacttctctgcacattatctcaacttcctgggttgcttgatcggataaagcatttatatttgtcttctaaaatatgactaaatactatccccaatcaaagtgacataatattccatagttgtgcaaatgtttagtttttttttttttgtgccgaaagataagtcacaggctggggtatttgatttttcttttaaaaatgataaagcagaaggagagagaaagagaccaagaaaataaaattgtatacagtgaaacacagatgttatctgaaaaatggattttttaagagaaatataggtataaaaggcattcatgagaaatacaagaagagagaaagagaagtgaataaattaaactcttttaattattgcaacagctcaaatagtagattttaactataatatttgatagacatgtgaggtctttatacatatactattttaattctctctctatatatataatgaaatgttattccaaaatgcaatataatcccgtggaaaatttattcagtcggaaaaaggagaaaataaggttctaatactgattttagtgcctcaggcaagacacataactttttgggcatcaatttctatatctgtaaaatgaaaacacacgccctactatgtatatcatatgtaaatgtctaaaatgagataatagtattgaaaatggctttgaaaaaaaatacaagggattgagtcactctaaggaatgactgttttttaggagtcaacaagaggcaaaggaaataaaatttattccaactaaatgaaaaagtgttactgaaatgttagccttttttttttttttttttttttgagacggagtctcgctctgtcgcccaggctggagtgcaggggcgcgatctcggctcactgcaagctctgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaatgttagccttttaagaatacaaaaaaatctaattatatatgaatacaatacctgaacccatgaaacttctgtagaatacatgaatctgtaaagttatgtattctaaacatttgtagccagaataactttcttcatattttccacattcttggtacacttacgtgtcacacatgttccctgtttttcaaacaaggtcaatgttttcattatatacatttacattgttattgtaactattttccaggtctgtcagtaaaatttagtctcacacattgataccacattcttgcaattatattgtaattctcacatagtaattcaagcctttttgaatatacaaatcatctgaatttattatatcactgctatgacacctcatacacatgttgagaccatttatgccagaaaagattagatttagtattcaaagagccaaatgtaaataattctggattgcttatccaaatggggaactcagagaacttctatagtttaaatatgcaaatattcaaaagtaatttttttgtgaccataccctcctgctactgaatgtttccttgagctggtgtcagaagcagggtttacaatgttgtgctctatttcctgtttaacctattgccaagatgttaattcagagtgaaataataagaacttagtgagaactgggggtgataaacaaagtgtcctcacagcggagaaactggaaaatgtatccttgaaagcgtgtgaatcgggtgagcgtacaacgggtaacatcagtattggtgttctcactgctgggtcagcactgaccagcagagtctggtgggagccagcaggaccagaaacatgtcctcagtttgggccaatttaaagaagttgggaagctttctagagcccggccgtgtgtctctgcccttgctacaactcctccctctgtctcacagccagagatgcacccatgatgacattcatgtaggctattaagggcgagcatttctcggaaggtgaagcaagatatggtagtcattccaagaaaccttccttctcagctgcgatttgtcaagaggaaagaagtggagttttcagtggaaagcagatgtgaatttggagcagtggggcacttccagagaatgagcccgggtcaattttcataggcaattggcaacatgaatgcataggcactgggaagaatgtaaatggcaagtccaggaagcaagtagtagctaacaaatgcgtgaaagagtagaggagtaaaataacgatttcatcctctgaatgctgcccagagtcaatcccactgtaccccgtgcagagaaagtgactccaggagtgtgtgcccagtctagaagaaacaacaacactccttccatgtagagccaaaatcgtgtgtgtccctcggcctgaggagctggaagaatcctgaatcttctccatttagggcaggagttttagtggcatgtcaaatgtgcaacatcctccaagcctagaacctagaggtggttctagaacacttttcttccttgcttccacatctgtccaattacccacctcaattaatagttaccagaatattcccagagaatcataccagcacactctttgcaccaggaaggggtacagatatgttacaagaagagaggtggctgtcagagtggaccacatgtctttttatagtttggtgctttgtctttcacaataccagcttgccgtctagcaggggatgtctagcgtctcctacaaacatactgattatctaggaacatcatagcaccaaagaggccttctgccctcttccattcccacattgttaagaaaaaaaaaaactggttacgtaaattacagcatattcatttaatacttggaatataaaaaggggtggaaacattgttaaggcccctgtctgtgtaaggatatagaaagcagccaagatatatctgtaggtaactaaaatgcagatgtgcacaatgctgccatgcctgtagaaaacaaggccgggtgcggtggctcacgcctgtaatcccagtgcctgtagaaaacaaggccgggcgcggtggctcacgcctgtaatcccagtgcctataaaaaacaaggccagacgcggtggctcacgcctgtaatcccagcactttgggaggccgagatgggcagatcacagggtcaggggatggagaacatcttggccaacatggtgaaatcccgtgtctgctaaaaatacagaaattagctgggcgtgcctgtagttctagctacttgggaggctgaggcaggagaacctcttgaacctgggaggcagaggttatagtacgctgagatggcactattgcacactccagcctgggcaacagagcaagactccatctcagggaaaaaaaaaaacacaacaagcaagtacacaaaaacgccaaacacacaaaactatacagaacatatgatttttgccaatattccagggtaaaaacatctcaagagttgatagattccagagtctttgagtgagcacactcggttcctatccttgatcccctgccctccggaaggcctgtttctgtcttctccctcacactcaccacctgctatcaggactctctgctccctactgtcaagactagacgtgcctcagacacagattcctcccttcttcagcaggagttcccagggccgagttatttattctagaaggtgcccctggtgatagtggtggggaaagcttctacaggtcatctgcagttacttctggtcctgtgtgtcactccgaagaccacttgtcatgtggggcggcggcttcacagaagcatctaggttagccagagacacttaaagcctgtttctctttgagaatgatggtaagcagaagacctttctctttatcttgtatttattagtaactattaaatatatatttttatacacacagacatataccaaagatgaacattgatccttatcttacggattctctagactcaaatgcttactgaagtcaggcagataaaacaaaaaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcagtcctcattggaattgcttgtatgttgactcaaaaggttaaatattgtgcagatcaaacaaataatttctgtgaggaggatttagtcaatgggtaaggagtttgtgaccttttgtctaaacacatgaaaaggaaggggaccatttgcctgactgctctctactttgctacgttctttctacacctgagttagtgctggtggaagagtgtttcttctccttcatccagctgctttcagtcatgtacccccccgtgaccccctcactctggttcaaacgcaaacacaaactgagaataggaaaataatccactgctgaggcatgaacatagcaccaaaggatgcagtactctagttgcaaagaactctggctgaaatttcccccacctcacctgctttctccttttatcttactcaaggctcatctctcttccagttcctctctggggaaacaggagggagattcttcttgtcacataaatgtgtcctgaaaggattctctcctccttatatctactcctttaatctgagttcaagtcatcaacacctctcacctggcccacttgccaacttccataccgtctgtctccatcctctaaaacaaactttccatgtggacaaagctgtcctttctcatgcctcagacgccactgagggcacaccaaggccattggcggcgtggccgtggacttacacaaactttccatgtggacaaagctgtcctttctcatgcctcagatgccactgtgggcccaccaaggccgtttgcggcgtggccgtggactttccttatggtcaccaacctgcagccttaagctttcactcaccctctttgtctgtccccagacttaaatcttttcttcatgttgacccttgaaatacgtgtattcatgaagacctgttcaatcacactctggattttcaaagttgaaaataacaggaagttactacggcaatgatgatttagtgaaaaatatgaaggaatcagtgactcaacaatttttgggccccattttttttttccttcaccagaggataatgttaatatgaagaggttggttgtcaatattacaactttagaaagaggaatacatgtatgtatgtattcttttatatttatgggagttaccttctgaaacctttgaacatcaccaatattgcggataaccatatgttttgataagctcttgggtttatctcgcattgcgatcaagaattgttttcactgcatatcctccaactacattaaatgccttttcaacattctttacaattttctacgtggcaaaagataccataaacaaaactaaagacaaataacagactggagaaaatattgtttgctttgagtataacgtggtaagttacgaaggaaatgacaggacactaaatatgggaaaatgagtaaatataccaagagcaaattcagaaagacctgtgcaatgagacacaaaattatttttaaaattataaaaataagcttaatctcactaataatctgaggactacatgttaaaatggcaatggaatttctttgatgaccaaatatcgttgtttgatcatgtcaagggcaagtgggcagggagaaatgtgtactcctcaactgcagataaaaagagaattgataaaacctcttaaaaaaatggattagatttagaagaatgaactatgtatacactctatgactcagttccatctgtgaacatgagtgtcagagaaaagtgtggcacatcttccagtggccaggtacacagtgttgtgcatgaccctgtgtgggaggaccacaaatacattttagttaagcacgttatggaagactatgtagtatttagaaagatgggaaggatctatatgtactgacatgaagtcataaaaattataaaaatcaaggtgcaaaatctgatgatttgatgccatgtgtgcaaaacattcttttatatgcatttcacaaaaaacaatattatgtatttctcattatccctaaaacaattctagaggattcatgacatgctgttacttgtctcaggtggacaaggattagaaatggtgaataaaaaaggttattttggcggggcacagtgacttatgcctgtaatcccagcactttgggaggccgaggtgggtggatcactggaggtcaggagttcgagaccagcctgaccaacatggtgaaaccccgtctctactaaaaatacaaaaaactagccaggcatggtggtgcgtgcctgtaatctagcgactcgggaggctgaggcaagagaattgcttgaacccgggaggcggaggttgcagtgttgcagtgagccgagattgcatcattgcattccagcgtgggcaacaagagtgaaactctgtctcaaaaaaaaaaaagaggttacttttgccaggcacagtggctcacacccgtaatcccagcactttcggaggacgaggtgggtagatcacttgaggtcaggagtttgagaccagcctggccaacatggtgaaaccccatctctactaaaagtacaaaaattagccaggtgtggtggcgtgcgcctgtaattccagttacttgggaggctgaggcaggagaattgcttgagccctagaggcggaggttgcagtgagccgagatcaagacactgcactccaggcccagagacagagagagaccccgtctcaaaaaaaaaaaaaagttatttttcacatggtagttcattaaaattttttaagtattaagctttatttatcaactgattaatattttttcctaatgaaacaaaattttactttttttaaaaagtctctttgtactattcaaatactgaatatacaaacattagctagtgaaggaatgaatactgagctgatagccaggcttacttgctagctgggtgactatctcacggaagtctagcaggatttgagatttcaatgagaaatattctgcaaaactttagagttgctgacaaaaggtaaaaaaaaaatgtgcttattaataaaataaggccaagtaatgaaaaatgtatttattaaatgaaggccagggaacactgtgtgaggcttcgtgggtgtgagtacttgctactggactgtcatttctcagttatacagagtgaaccagaggtagatagggaatagttattgtcagcaggatctatagaaatagcaacagtggtgaggagtagaaggatgttggatcaaataagatagtgcagataacaccatagaatgctagagccaaaaggatttaacacatacttttcttgataagaaataggagacaaataaaagttcaatgatttgctggaggtcacactgatatttagtggaagaacaaagacctagggcccttcaagagtagaaaatgttatacaaatgtcaaccgctaagcattgggggtatttattgatctttataatttagaggtaatgggctctgagcatcagaccatctgataactttagttcatcagattctcaaagtgttcatcactagaagaagctaaataactgcgttactctgaaaataaaaaatgaatattgagtctgttatacattctttgattttaggatgtaaaattccttttctacttctcacaggcagcactgagatctatgttgcaaagtaaattgggatagtattaaaaccatttgcctcaagggtttttttaataagtttcttgtgataatgtatgtgaatgccccaagtatatgtgacccatgggctggtctgtaggtgggacccactacatcggtgaatcatgctaagctcttaatgactcattgtaggtctctaaaataatggtatttacaaattcaagacacatctttcatgaatagcaaacgcttaccatacaatagcaaaatgaagataacaccaactgaactctctattttctgtttctgtttaacaccaactcaattgttcatttccccacgtggttgagagaggaacattaaataagtagcaatgttgggctggctggtggttctaaggatcacctagaaaatggaatgccagagattgtttagaaacagatctgagatactagataagatgaaaataacaatataagcacagtagtcttcgtaaccaagtcttatgtgattcagaaatcaataatctaaattacagagatcagtacctattacaggaaacagtcgatatcctctggggcagggttttacctctggtgtagcctcatataagtgaaaaagaaaggctaaacgtctttgacccccaattcccattcccttcacagaaaactagctaaatatctaaattgctaccattaaatcacattaaatattgctcttctgcactttctggtctggtgttgtaaaaagcagttggttgtgcatataagaatgagggaaatggaggctatcattgggacacaacgtatatcataacagtacgtgaagtgggtggagcgctaacctcagtgtttctgcaagggagtctggactgcccagagtgcatccgtgtcatcctgcatttggacatcatcaccaatttctttccaaggacccttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttctgtctaccaaaaggaagctctattgcagccattcaatggtaatcctgcttgtactcacagagtactactattctaagagcttggtaatatactgcacatttttctcttctcttttctcttctcttctcttcttctcttctctttctttttcttttgacggagtcttgctctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagtagtttctcttaagtcagctaaggtaatcatgcatcttccttgattctttaagactcccctgccctgaaatatctcccctaaaagtctgacacaattatagaacaaaggatactatgtcttattaagaagtttaatctcatcgttattaataagtaaatatgtgatatggtttggctctgtgtcccctcccaaatctcatcttgtagctcccataattccacgtgttgtgggcaggacccggtgggagatgattgaatcatggggtgggtctttcctatgctgttcttgtgatagtgaatgggtttctgatggttttaaaatggggagttcccctgcacaagctctctctttgcctgttgccatccatgtaagatgtgacttgctcctccttgccttccactgtgattgtgaggcctccccagccatgtggaactgtaaggccaataagcttctttcttttgaaaattgcccagtctcggttatgtctttatcagcaatgtgaaaacagactaatacaatacgcatttttcttgagtatagaattaacctgttatatttttcctaacatagaggaggtagtctggagagatttgaaagaaacacagaggtacaattaatttattagccaagttcttcaggatctcctaagagagaaacagagagagaggtagtgcagtaaagcttccatctgatgcatagctagtgtgaggacacgtgcctagaggcagaaccagggaactgggaaataggaacatctgtattaattttgctgatgatctaccctgaacacatgctttatgttatgggttggctgtgtccccacccaaatctcttcttgaatgaattcccacgcattgtgggagggacctggtgggaggtgattggatcatgggggcaggtcttacctgtgctgttctcatgatagtgaatgagtctctcgagatctgatggttttaaaagggggagtttccccgcacaagctctctctttgcctgccaccatccatgtaagatgtgacttgctcttccttgccttctgccatgattgtgaggcctccccagccatgtggaactgtgagtccattaaacctctttttcttcccagtctcgggtatgtctttatcagcagtgtgaaaatggactaatacagtaaattggtaccagtagagtagggtgctgctgaaatacccaaaaatgtggaagcgactttggaactgggtaacaggcagaggttggaaaaatttggagggctcagaagaagacaggaaagtgtgggaaagtttggaactccctagagatttgttgaatggctttgccccaaatgctgatagcgatatagacaatgaagtccaggttgaggtggtcccagattaaatgaggaacttgtaggaactggagcaaaggtgactcttgttatgttttagcaaagacactggtgacattttgccccttccctagagatttgttgaactttgaacttgagagagatgatttagggtatctggcagaagaaatttctaagcagcaaagcattcaagaggtgacttaagtactgtcgaggcattcagttttaaaagggaagcagagcataaaagttcagaaaatttgtagcctgacaaaacaatagaaaagaaaaccctggttgggcatggtggctcacgcctgtaatccagcactttggaaggccgaggtggatggatcacgaggtcaggcattcgagaccagccctggccaacataatgaaaccccgtttctactaaaaatgcaaaaaattagccaggcgtggtggcaggtgcctgtaatcccagctactcaggaggctgaggcaggagaattgcttgaacacaggaggcagaggttacagtgagccgagatagcgccactgcactccagcccgggcaatggtgtgagactaggtctcaaaaaaaaaaaaaaaaattcccattttctgaggagaaattcaagctggctgcagaaatttcataagtaacgaggagccaaatgttaatccccaagacaatggggaatatatctccagggcatatcagaggtcttcatggcagaccctctcatcactggccaggaggcctaggaggaaaaagtggttttgtggaccagacccaggatccctgtgttgtgtgcagtctagggacttggtgccctgcttcccagatgctccagctgtgactgaaaggggccaaggtacagcttgggctattgcttcagatggtgaaagccccaagccctggcagcttccatgcggtgttgagccttcgggttcacagaagtcaagcattgaggtttgggaacttctacctagatttcaaagcatgtatggaaatacctggttgtccaggcagaagttggctgcaggggtggggctctcatgaagaacctctgctagggcaatgtgaaagggcaatgtggggtcggagcccccacacagagtccctactggggcactgcctagtggagctgtgaaaagagggccaccgtcctccagacctcagaatggtagatccactgacagcttgcactgtgcacctggaaaaaccacagacattcaacaccagcccatgaaaggagccaggagggaggctgtatcctgaagagccacagagccaggagggaggctgtatcctgaagagccacagggtgaagctgcccaaggccatgggaacctacctcttacgttaccgtgacctggatgtgagccatagactcaaaggaggtcattttggagcttaaagatctgagtgccctgctggattttggacttgcatggggcctgtagcccctttattttggctaatttctcccatttggaaaggctgtatttacccaatgcctgaacccctttgtatctaggaagtaactaacttgcttttgattttacaggctcataggtggaagggacttgccttgtcttgaatgagactttggactgtggacttttgaattaatgctgaaatgagttacaactttgggggactgctgggaaggcatgattggttttgaaatgtgaggacatgagatttgggaggggccagaggcagaatgatatggtttggctgtgtctccacctaaatctcattttgaattcccccatgttgtggcagggatctggtgggaggtgactggatcatggaggcaggtcttacctgtgctgttctcatgatagtgaatgagtctctcaagatctgatggttttaaaagggggagtttccctgcacaagctctctctttgcctgccaccatccatgtaagatgtgacctgctcctccttgccttcaccatgattgtgaggcctccccagccatgtggaactgtgagtccattaaacctctttttcttcccagttttgggtatgtctttatcagcagtgtgaaaacagagtaatacactttattacattttccttctacaaaatttacattttttataacaatagttttcatttgtatttctttttggatgacaaagacattttacagacattttatcattgaactctacaatattaagtgttagagcaagttttagctatttaacaataaggaaatggagcttcagcgacctgttgtagttaacatacataataagctgaataactgggtcatgtattctatgctatgttttcctgagttatgtaggtatcctgtataagaaaaaaaatctgtttcatgattctatgaaagtattttgataacttttgatatataagacttattagtatgggtatgcatcaaattttctttcagtatacaacaaaataaatttagtaaagtaagtataatgtaattcaaattcctataaacaacatttagtaaatatctaaaaggaagtatcagaaatactactaaagttaatacacacacctgcctacactcacacacggcacacattttcaaagatataaaagcacataattgaaaagtatgttttctggggccgggcgcagtgactcacgcctgtaatcccagcactttgggaggccgaggcaggcggatcacaaggtcaggagatcaagaccatcctggctaacacggtgaaactaaaaatacaaaaaattagccgggcgtggtggcgggcgcctgtagtcccagctacttgggaggctgaagcaggagaatggcatgaacctgggaggcggagcttgcagtgagctgagatcgagccatcgcactccaggctgggtgacagagtgagactccgtctcaaaaaaaaagtttgttttccacttgtgtgtggtagccaggtgaacagtccagccaaacagtgacacccctagagaagatattgagcatgatttctttctgttttccttttctttttttaacacaaatgatttcatcctacaggttggtttcagcctttcttttatcacttatctattcacacaaagataagcacatgtgcatgcacacacacttttttcttctctctctttattccacagcagcacagaaagagttaccatcgtctttttaatggccataaaaatatatcataattgatttgaccggttgaacatttaaagtatttgcaagtgaatcttgctgtgcagacatcatttagagtgtgtgtagtatgtccataggataaattcctagaagcaaaattattaggcaaaagaaatcatgcatttttaattttaagaaatattcctaaattgcttcagtggatagtatataaatctatatttccactagtaatgcatgactgcatgttttcctcacagtgccacccacacactgtgtcatcaacatttgtgaactgtattaacctgagagataaaatatgttatgtaattaagttttaatttgtaacttttcctttataagtgagattgaggtttcccccactttcatatggtcttcccgtttgttcaccagactattagtcttttcccagatgattcatgaaaactggacatgttaagaatatgaaccccttagctattaaaatggttgtaattttttccaagttttttttgtattgtttatggaattattttatatatagattttaatttttatgcaattaaacatgtttattttatatattggagcattttgtcatattacaaaatccttctccaattccaaactttaaaattcttttttcccaatttattttagccttatatcctgtatttaacatctgtaatttattttagggtaaagtgtgaggtatgtatctcactttatttcttttccagatggtaatttatttattacaatctatcttataaaataaatcacctcctctactgatttgaaatgccacttttattgtataataaatttctgcacattagcaatattttactgtttatcaaaactacatcataattcctatttgtatattgctctattgttctttctagttattgtcagtctaatattttgaactgttctctaaacatacccattacagaaatatagtcctgtttatttacatatgcatgtttgcacttatttatgatgtatgtactacataagagttggggatcaatatataccaaaataaattacattgttcctgtccacatcacaaagtttaagataaattaaaaagttaaagtatatatgaaactatatatgccttttgagtaaaaacaaggaaattctttttcaaaaagcaaataaacaagtttattattttagattcatttattgtagttaataccttatttcactccaagttttctaataacgaatgtaaagacgaaacatgttgacatctactgtgataaagaaagttcatttcctagcagttaattctaagtaggatgctgggcctatgcaagtggtgatgaatagcataaataagttagcttttccaaaaaattaaatgtttagaagtatcttcaggccaggcatggtggctcacacctgtaatcccagcactttgggaggtcgaggaggatggatcacgaggtgaggagatcaaggccatcctgactaacacagtgaaagcccatctctattaaaaacacaaaaaattagccaggcgtggtggcgggcgcctgtagtcccagctactcaggaggctgaggcaggagaatggcgtgaacccgggaggcagagcttgcagtgagctgagatcgtgccactgcattccagcctgggcgagagagtgagactctgtctcaaaaacaaacaaacagacaaacaaacaaacaaacgtatcttcaaatggacatttcaaatgtttcttctttttataagttgagaaagtaacacagaagcatcagtaaaatgtcttcaggcaacaacgtagcatcatgttggtatgtcacttactggaaagaagattatatatcttttagactcttcccaaaattaaaaaaaatgcacctgtcaaatatgaaatactggtaaagttcaaagaatccgtaatgtttgtggatgattaaaaatgtgaaaactgtgacagattctttctcagtcagagtaatttgatttctgcagagcgggctatagaccggtcttcgggtactttctcaaagattaactgaattttcttaaacaaatatttaatttgattaccagaatatgaaagaaaaaaattttgtctaacaactctttctgaagtttgccaatagctttcttttactgccaatacgacttttctgaagcatttcattatcagttgatctttgtcttcttaagtcagttaatgatacgacacgaacaaaatatattatcatgcaggtaaataaaaactgtcctgttggaaaacttagtgtttcctatttaaatttcagaaaaattcagctttttttgtggttgatattcaatgcacaggcattagaaaaagggtctattgtgtctgaggttttttctggttttaagtgataaagccatctttggcatgaaggatacttggttctcattttcagtagaaagtggcatgcatcccagttacccaatagttatcctaaagcactgaactaaacttaagacataaaaaatgtaagtacattcttttgaacgtgattgagaattggaattttatttgtcaaaatattttacatatgcttattctggctgccatattatgatgcttactgtgtaaaagcttttgtggtattgtatcttactgagatagtatagttttttgatagatgatttctattcgtggactcaaagcctcataattatattatatatgttaggaaggattttccttattttcctggtgacatgaaaaatctatgtaagtgatttataaggagatatctgcacagagatctgtatgttcctttataaattattaatatagagatttaatttaaacattattatgacagttagccaatagtgatattttgagggaatattctatagactcatgagtttgttattctgtgacaataggttttcaccttttaaaataaaaaactatactcacattcccctctgagagaactctataggccgggtgcggtggctcatgcctgtaatcccagcactttggcagcccgaggtgggcggatcataaggtcaagagatcgagaccatgctggccaacatggtgaaacactgcttctactaaaaatacaaaaatgagctgggcatggtggcaggcgcctgtagtcccagctactcgggaggcggaggcaggagaatcacttgaacctgggaggtggacggtgcagtcagccaagattgtgccactgcacttcagcctggctacagggtgagactttgaaaaaaaacaaacaaaaaaaaaaccaaaagaaagaaagaaagtgagagagagagagagaaagaaagaaaggaaagggaaagaaaagaaaggaaagaaaagagaaagaaagaactctatctgtgcagttaaatgagagaaagaacacatagtttagaggacttttatagagaaagaacacatagtttagaggacttttatagagaaagaacacatagtttagaggacttttatagagaaagaacacatagtttagaggacttttatagagaaagaacacataggttagaggacttttatagagaaagaacacatagtttagaggacttttataggacagacccccaaatattcttgcagtgctaggcctcttgggagatattggtaaaatgaaataattatttaaaatctatgaaataaatgtaaatctttaggataagttgaagcatgtaaataagtcttgacatagagtaaaagagaggagtgagatttgtatgtgaatataagattcagatttttaaaattttaatttagtcatctaaatggtctcctgtactgattatactcagctacttaaaatgagtaattctacccgcaaaggtagctagtctctataattgacttaaatgatgtacttttaatcaatatttcaatttcatttgatgcccttgaaatgatgtggaaaataaaaggaaaactagaacattaagtccacatggagcaatataggaaaaaccaaataaaagatttcgaatgcccttttatgtaattaattgctttcaaagaagcaaattccaaatgtcagagatatataaatggatattcaagataatgtttatttttgttcctatttttatgtattacaaatagaggtaatatttaaaacaacaaaaggggtaaaatttaaaaatttagaaaaatatagactactgaagagtaactgccaatggcatgtcttattaatgagaattcttccctagggcttttaatttgaggtggagagagcagaagcagcgggcacggggcagcttctctctaaggtcacatgctgtggtgcaacactgatttaaagttgtctgcctcagatccacatcaagatggttagctactagtacagaggaactttactaggtaggattttctttctttctttctttctttttttttttttagaaaaagtttccttcttgttgcccaggctagagtgcaatggtgcaatctcggctcactgcaacctcagcctcccaggttcaagcaattctcctgcctcaccctccctagtagctgggattaccagtgtgcaccaccatgcccatgtaatttttgtatttttagtagacagggtttcggcatgttggccaggctggtctcaaactcctgaccttgtgacccacccgccttggcctcccaaagtgctgggattagaggtgtaagccacggcaccaggcctactaggtaggattttcttagccatgatatgaagcatctttcccctgcttcctggtcacatgcttctgtaagcacaaggcctctgacctttctccaaaggtgcagctagtagcccccgcttgctgccaagcgagtccacaggctctatttgacgtccagttagatctgatctttgaaataaaataagtaagctattggaaatcagtaaaaatatcaactagagtctgggcgcagtggctcatgcctgtaatcccagcactttgggaggccgaggcaggcggatcacgaggtcaggagatcgagaccatcctggctaacatggtgaaacctgtctctactaaaaatacaaaaaaaatagccaggcatggtggtgggcgcctgtagtcccagctactcgggaggctgaggcaggagaatggcgtgaacccgggaggtggagcttgcagtgagccaagattgcaccactgcactccggcctgggagacagagtgagactccgtcagaaaaaaaaaaaaaaaaaagaaaagaaagaaaacataaaagtagtaaatatccctaaaactttaattatactttgaatatgaatatttgggcatagttttttaaaaactgcaaatctgtccaagtaaaagattgtttttctgggtgatttagggataattaccttttttaaaatcatggtctgttttatgtgtttccaagagcatgcactttggtaattaaatgtggtagtagggatgtttgaatggaaaccagaaagatattttcataattaataattagtttataaaaatcactagcattcctgtacaccaccgacaaccaaactgagagccacatcagaaagataatttgccaccacacagaaaaaataaaataaaataaaataaaataaaataaaataaaataaaaaagacctgggaatgcagctaaccaaggaggggaaagatgtctacaatgagaattatgaaacactgctcaaagaagttagagaagacacaaacaaatggagaaacattccatgctcgtggataggaagattcaatataaataaaatagctatgctggacaaagcaatttacagattcaatgctattcctatcaaactatcagcgacatacttcacagaactagaaaaaattatttaaagatttatatggaaccaaaaaagagcccaaagagccaaggcaattctaagcaaaaagaataaagctggagaaatcatgttacctgacttcaaactatactacaaggctgcagtggccaaagcagaatggtactggtacaaaaacaggcacatagaccaatggaaccgaatagaaaccccagaaatacagccacacacctatgaccatctgacctttgacaaagctgacaaaaataagcaatagggaaaagactcccttttcaataaatggtgctgggataacttactagccatatgcagaaaattgaagctggactctttctttacaaaaatcagctcaagatggattaaagatctaaaactataaaaaccctgggaaacaacctaggtaataccatcctggacataggaacgggcaaagatttcataacaaagacaccaaaagcaatcacaacaaaagtaaaaattgactaacgggatctaattaaacgtaagagtttctgcacagcaaaataaatgatcaacagtgtaaacagacaacttacagaatgggagaaaatatttgtaaattatgcatctgacaaaggtctgatatccaccatctataagtaacttaaacacatttacaggagaaaaatcaaacaacctgattcaacagagggcaaaggacaggaacagacatacatgcagccaacaagcatgtgaaaaaaagctcagtatcactgaccattaaagaaatgcaaaacaaaaccccaatgagtaccatctcgcaccagtctgaatggctgttattagaaagtcaaaaaataacagctggtgaggttgtgaaggaaagggaacacttaaacactgttggtggaagtgtaaattagttcggccattgtagaagacagtgtggcgattcctcaaagacccgaagtcagaaataccattagacccagcaatcccattactgggtgtgtacccagaggagtgtaaagcattctacctaaaattcacatgcacgtgaatgctcattgcagcactattcacaatagcaaagacaaggaatcaacctcaatgcccaccagtgacagactggatcgagaaaatgtggtacatatagactatggaatactatgcagccagaaaaagaatgaggccatttcttttgtgagaacgttatggagctggaggctatcatccttagcaaactaatacatgaatagaaaatgaagtccaggtgcggtggctcacgcttgtaatcccagaactttgggaggacgaggcgggcagatcacttgaggtcaggagtttgagaccagcctggccaacatggtgaaaccccatctctactaaaaataaaaaaaaaaaaaaattagccaggcgtggtggtgcatgcctgtagtcccagctactcgggaggctgaggcaggagaattgcttgaatccaggaggcagaggttgtagtgagctgagattgcaccactgcactccagcaggggtgacagagcgagattccgtctcagaaaaaaaaaaattagaaaaccaaataccacatgttctcacttataagtgggagctacgtgataagaacttatgaacacgaaggaaacaacagatactggggactgcttgaggggggagggtgagaggagggagaggagcagaaaagatcactgttgggtattgagcttaatacctgggtgatgtaataatatgtacaacaaacccccatgtcacatgtttatctatgtaacaaaccttcatatgtacccccaaacctaaaataaaaactatgaaaagaaaaaataaaaaaataaaatctggggaatttgagttggcaaagcctctgaagttttagctattgtgctctagtctgtttcactacaccccacaaataaaaatttaatttgcaatactggaaaaagtcttttatgtaaaggatagatatgttagattttttaaatatgctaaattaagttctcctcttattccagttcaccttgctattgtaaatctatgtttaaataaaagtcatcttcaaacaatattaaccaagttgcctgaagtccaccccttaataatctgagctaattaatcattcttcttggtcacttcctgaaatctctatttcaagacatgtacattctagatgaaatgtattaaaaagacacacggaagtgaaatgctttgaaagcaggtacattttgcttccccagcctgtaagatgtcagagattatgtgttatttctatgtatactttgtcctgatgaaaataaaattttatttgtacctagtattttataatttgaataaaggattataatcaatattcttctcttctttgcttctcttagctgatggccctttttttcagcagttaattaaagtttgaatagctgtcacttgtgactaacttctgtggcgtttcctttgcctgcacctcagacatcatctccttccattcatttcttctcaaattgcgtacacaagtgctctacaaaatcatctacagtcaaatcccagagaagtagtaataagagccattgtagacaggaggaagtgtgttaggaaacaagaaggtagatctggagccagtatagactgcagccaggaccgcatgttccttagggcaatggaaagaagaggagataaatgctgtaagaagatgatatagaaaatttaaaaactgttatacactgttcaaatctcatcaaaggcatcaaagaggatcccattaaaaacactcttgagagcagctgagcgctgacgctttgctgcttagaatgcagggccaagggagatatgaggtcgggagggtttaggtgtgcacctgagcattcagagtaaagagaaatgagcactgggaaaagctaaaaggaggcagcctgagggggccagcaggaggccggccggccggccgggatggcaggccaccttcagcaggtcagccttcaccctggcaggcagatctaacgcggatttgggaaaaagagacactctcagtccctccagattctgggatggtttggtctctggctctgaggttcccaggtgaaactgatgctgctgcaccttgccgtgatgcagtgttactcatggccaagagcagaacttcagatgggagagggctgactctggcttctgctattcacagccatagtgtatgggaaagtcaaagaggcttcatcattcagtaacaaaaacaaatttcagtcacgtgaggaaaactaaactgagctttatgaactttcctttcccctgtcttactttgatgtcattttgtcttgtaatgcaaatatagatatgtttaatccatatttacctttctaattaataaacagctagttttatatagataaaagctttcaaattttattcaaaggaggttttctcagagtgctgattttcattgttcatcaggcaggtacatcatttagtggaaaccaagtaaaattgtatccatgagtccaagcacagtcctccagtattttgtaggattcatctaaagacttaagtttaacattcatgtaattccctctaggatgtacagttcctcagtctcacagaattagcccagtacctgctcttctgggtgctaggatgccatagacaccctgtagttcctttatccaaatcccattacacttcaggtttgggattctaattcattaaggaactgaggccttttcatgtagtatttgtataaatgctgagctctcaatatggaagaagaaacaggaaaggaagaaagaggggtggggaggaaaaggaataggaggaggagaagaaggaataggaggaggatgagaattaggaggaataggaacggggggcggggcgaggaataggaggaggattaggaagaggaggaaatttgcatatggctttaagtcccttaagcttctggttaagtggctcatctacacaaaccccatctcatgatcccgtgacataggagctatttcctctcatcactactgattgtcctccatgttccctttgacttatctttcatggccacatgaccccatccccaccctctaaatccaatccagtggacctccacactctgctgcccagccctcttggtgatttctgagctcttttgctgtaaacacaagtggacagtcatctgaggcagcgttctttactatctgcactctccagagcacagttgagcctgagttccaccccagcacatctcaacctcagttgatttcagaacctttcaatcatttctgtgacatttctgaatttcctgacttcaccaatgccaggaggataaccctccgaatcaaatcgaagatcatttcattgtaaagttcctcctatattgacatttctggggaactatgacaaactcaaggcctcggagggccctagactccatttcattaaatacaatttttgaatgggtatcagggaccttgacctcaggaaataacttgggcaccatttatgtcaacataggggtcatcaacgttgctatgatgtttcctttgggttcatttaaccctatttaaccacatatttcaacaacagaaagatttaaactcagagcaaggtggtcaacagcacacatctattatgtaccatttacagactcctgaagacctgttgttctctctctaccatttggtctcttgccatatttcttcaggtttattagtgatttatctctttttgttaggtattttcctggtccaacattattttataattcaaatattagggcacagaaacaaaaatagaatgtgggtttgaatacacatgaaatacctacatctatgtcatacatatacacatacactaaaatagtttgcaatgggtatagaaattagaagggggataatataaagtaaacttaaacagcttcagaattttgccagaaaccagccctgaacttaacgataaccccatctcagtagaaagaagagaggctgagtaaaggcatgtttactcggaaatgagttccccagcgtgaaactcaagagtgaggagagagaacttttagaatttgccacacacctgctttctgttgcatattaaccacacggtgcactttccactggctgcttgaacaggcacgtcatgtgtgaatgaagtgggtcaaggtcagaaaaatagcgattgttggtgtatgtgataaattgatgtgtacttgccctgggtcagtcactactcacctgcagaagattcctgccttataggaagtaaaatctgtattgctgaatctcacacatttccagaaaaagccaggaagtgtggctactacaggaaatttcctaatttttaaatatgaaatgattcaaacatactgtagaaaaaaactatacaatgtacagtaaccacgcaatagaaatacatctgatgaatggatttggctcatgggccgccagcttgtgacttctgatcaatgttttgaaattatccctgggagacatggggaagaaagattcaatctgtaaggagccacatgcagttttgtgagacaatttgcagacttcaaagtgactgagtcagagtatgtacataaaacgtggcccaagggagaacagaaatctaaaatgaaacacattaaggttaatactggccgggcgcagtggctcatgcctgtaatcccagcactttggggaccgagtcaggaggattacttgaagacaggagatcgagaccaacctgggcaacatcatgagacccatttctacaaaacaaatggaaaaatagttactacccataggaatgaaaagtcactcatttgctatcacacagacatacacatgtatgatagccaactaccggattaaatcaggcagtcagaaagagaaaacaaaaagaaaaggaggcaaaaatacaacagaaaaacatgaaatttaatctttcaatttcgaactttttatcagacaaggactagaaacccaatgaagatgacaaaaaaaaaaaagacaaaattgctttcctatgtatcaagctcaggtgtaattatagttccacactaaactgcaggcttcatacaaggacttgccacaactcttagttttagtaccggctgtaatttatgttgtgtttagataaattcctgagctctctgtacctaattttttttaattagtgaaaaaacacagaaatagcttacatgcttgctttaagaaatagataaatagaatattatatttttaaacctcattatgcctaagtatttaatatctactggtgattttattcttggcgagcatagcaggggccatatgagaaatgtaaatatggttattgacctgttgtgctggtgacaagatgagtcttttctctaggagactggattagcttggctgaaaatattcgttgcataccaaattagactatacattgtatttctgtcactgaatgttttccttagttgttttgtgagtaaaataaattggatgtatgttcaatgtatataattcaggcaccttatttcaaaagtaattaatgtcttactcacttgagaccagataattacagttaatgtcatcttaaaggagcccccaggactgttagccattggtaaacgcataagaattggaataaattgactttcatgatcactgaagcttcgttgggagaactaggagcagagaaaagaatgataaatcaaaaattcgtctcctaagactgatgaagataacatatatattttttcatttactcttagacaacccttacaagatttttgcccagcgaaagtggcacgtggaacatggaatgacatttcataaagataaatccagagattagtgctgaagactacacccctgtgtagtcccacacaggctaccccagaccagcctggcgggctctgcactaggcctcccatcaggcgagagccaacgctcctcagcccggctccacctcattcagaagaaagtgtgtctcccggcctcacattgcgctgaatgcaaggataccgagataaaccaggctttccttcgctcagagtacagttgcagacttggtaatgactgagccaagccagactgactgtgataagataataaattaactaccagtcaggagctaagtcagcagatgtgcgaacattttagaggtaacatcataaactagaacagaggagctcttgggaagaaaaagggcttggaaattatacctggaaagataccgctaataatgatcaagaagaaaaaacaaatccagtttggaagtgagcaatcatttatgatgtaaaatatttcttagaaatggaatctagataatgcttggaatatgctttaaactacctatatttaatttgtttttcttgtgatttttgtattgtttggtgtaaaataatcttaatctttccaggtggtgtctaattaaggcacatttactgatatgagtcattttctaaatatactttatctaagaaaatttaaaatttttggatcaactaaaaactctctcaattattttagagttaactcttccaaattctaaaatgtattcataaattatatacaactattttaatggtcactgtgggcccaacttctgtatataaatttaccttcttattttacaggtgctaatgtttaaagatacttaaatatgccaatttctttcctctatgtagaagtttgaaatacattctatgccctgagagaaccctttgaaatttgaacacatagagtattgttatgtgctttcaaaactttgtgttgtataggaccctcttttagctgaatatttttcaagcagtaagcctgtcctgcatcgcacatgtactgggacacccatggacaaaatcataagactctgtcttcctgacagatttccctcctctcctggggaattctctaatgatgtcactctttttttgtgccctgtatggtttttttttttcagtttcttctgtgtgatgcacgtgatgctgttacactgcagggtagcgtttttaaaaaatctgatttacagtttgtcctactattatatattttgcttataaaaaccttgtgttttttcaaaaattcctaacagacttatttaggtctaactgacctaaaataaaccacacatggtacagtgtacagtttgatgggcttcgacataagcacatataatgggttgaattatgtccctcacgagatatgttaaagtcctaaaccctgtttctcatttgcgaatagggcctttatttggaaatagggtcattgcaggtataattagctaagatgaggttgtagtggagtggagtgggcccttaatccccttaatcctaaatgaggggtgtcatcataagaaagacactggcaaacagatacagacacagagggaagaacgccacatgacaaggaggcagggggtggagtgatgctgccacacgtcaagaagaacctgcggccaccagagttagaagaggcaagaaaggattctctcgtggaggcctcggactggcatcgccttgccaacaacgctgatggtgggcttccagcctccagaattgtaaggcaataaattcatgttgttttaagccaaccagtttgtggtgaaatagccccaggaaacggatccaatctacaatcatgaaaccatctgaaaataaaaatagcaaacatatccctcacctcaacaagtttcctgaaggccctcccatcacacagtcccaagtcccacctccttcctcaggaaaccactgaactcttttgtcactatagaccgtattttgtagaattaatataaattttacataaatttatataaatccccaaattatagaaaatatatttactgtatacatgcggtatatactggctgctttcagcataattatttggaggtttattcatcattcttttgaacattcatttttttgctcctttgtttagctaagtagtactcccttgatatatcacaatttgtttatccattcacctgtttatggacattttagttgtttccaacttttggctatcacgaatgcatctgctgtatgtgcacatatacatgtacaactatttgaacagagatacacttttgtttctcttggtagacacctaattgtggaacagctgagtcctgtaacaggcatatgtttaacttttaaagaaactgccaaaccactttctaaagtaaacatactatgtacaatctcactagcagaatataggagttccagttcctccacatcttcatcaacagttcgtatgattacgctttgaaattttttcctttctaataggtatgtagtagtgtctcattgtggttttttatttacatttccctaatgactaataatactaaatgtctttcataggcttatttgtcatggcatgcctctggcataccatctgttcagatcttttgtctattgtctaatttttatgggtttgatcttatcaatttttgaagattattctggatacaatgaatttgttagatatatgattcctatttttcatggtctgtggtttatcttttctttctcttaacgatattcttgaagagcaggtgttcttatttttacgaaatttcttttatcactattttcttctatggattgtgtttttctatgaagcaacctttctaacccaaagtaataaagtttctgttatacagcttattctagaagtttgatagttttaggctttaccttggttctatagtcctttctgaattaactttcacatgttatgttaggtataaagtctttttggtttgtttgcttttgcttttgtatattggtatccagttgttctagtactagttaaaaatactatttttctttattaagctgcctttgtacatttataaaagatgaattgatcatatatgtgtaggtctgtttctaaactttctcttctattttattgatgtatttgttggtcttgaggcaaatatcacattgtcttgattattgtacctttataatgattattgattgctatacgtgcaagatcctcaactttgttgttttgcaaagttgttttgactaccttgggaactttgcatttttctagtaaccctgttttgatatagattattttgaatagggaatgttttgacttaaaaataatatcaaacttttataattaagatataagtagtgtgaaaggagagaaacatcttcattctatcattcagcccctttcaggaacctcatccaacctcaccactctaggctatcagagttagcacattacatctctatacagacatgcattcgttaatgatgaggatatgttctgagaaatgcattattaggcaattttgttggtgaacatcacagagtgtacttacacagacctagctggtgtagcccatcagttaccttggcaatatggtatagacgattgttcctgggctgcaaacatgtacagcaggttactgcactgaataccgcaggcaattgtaatacaatgataagtatttgtgtatttaaacgtagaaaaggtacagtacaaatttgatataaaagattaaaaaacagaagacctgcttaagcccattctgttacaatcttatgggaccagcattgtatatgcagagtccatcgtggaccgaaatgtcactgtgtggagcacaactgtatctccatccatactgacacacacacgccttctgaaacccatgcctacaaccatattggtatctgtatattggtgctttatagtataaaatataccctcttgaggctgagcctcagtaaatactcatgcttagccactgtcagcctgcttcttcctctaatctccaaaatgaagtaagttcattgacagcactggagatgcctgcattgctggatttacactctattttattattaaagaaagggtttttttctccctaaagatatccctatttctattaatcttttctggctcattatttttctttgataggcatagagggcagtatggtggaagtattctgcctgtctgtgagtattttaaaaaatggaaaatgttggaaatcaatttcttgtgcatttactttttcttaaatactattactgtttcctttccaatcttagactgctgaattctgaataaatctctcacctttgtggttttcttgaagtagaccttaatttgaattttttttttttttttttgacagagtctcacactgttgcccaggcgggagtgcagtggcacaatctcggctcactgaaacctccacctcccaggttcaagcgattctcctgcctcagcctcttgagtaactgggattacaggtgcccgccaccatgcccggctaattttttgtatttttagtagagatggggtttcactatgttggccaggctggtctcgaacacctgacctcatgatccatctgcctcagctcccaaagtgctgggattacaggtgtgagccactgcacccagccgaaatattttcttttctttttctttctttccttctttttaaaaaaattctgtagctgatccctgatggcttttaatttgaataaaactttatttaaagaaagtgtttattcattgatacgaatcacacagagtataatttcaagcccattaccatgaagatattttcctatgttttactccagaatttttaattattttatctttcaaatttagatctatattccagctagaattgtgtgtgtgtgtgtgtgtgtgtgtgatgtgaaggtcaaagtttatttttctttttttacatataaatatgtaattgatccagcaccacttaatgaaaagactactcttttcagccactctcaggtggtacctacgtcgtgacccaagtgactgagtatcgagtcggtctggttttcaactttctattcagttcggttgctctgtagttccccccttgatggtttacattgtctgtgaatattgacagttatagttcttactttaccattcttttaaggaatcatttgaaaaattcacatattggtgaagccatacaggcttagagttttctttgtggcaagtttcctaatgacagatttaatttctttaatagatacaatatattccaaatagatttttttcaatgagttttggtaagctatatttttctaggaatttgacaatttcttctaaattttgaaatatattggtatataggtcaaaaaattgtatgtctttatctttttaatatatgtaatgtctgttgggatgtacctttttaaaaatttcttatattattcatttctcttttctggcctgatcctagcaattgttatagggagtttataaaaattattcgtctttttagggaaataaatttttgctttttaatttttctactatatgtttgttacttcatcaaatttaaattaaatttttttggattaacctacatttccttcttcccatttttattaggattagtttgttcttatttttccaactactttagaacattctttagcttttcctctttgctaatatgtagatatacatttgtttctttcttcctttcttttttttgagacggagtctggctctgtcacccaggctggagtgcagtggtgggatctcagctcactgcaagctccgcctcccaggttcacgccattctcctgcctcagcctcctgagtagcttggactacaggcgcccaccaccacgcctggataatattttttgtatttttagtagagacaggggtttcaccctgttagccaggatggtcttgatcccctgaccttgtgatccacccaccttggcctcccgaagtgctgggattacaggcgtgagccaccgtgcccgggcccccatatagatatacatttctctaagcagttttacctgcctctctaaaattttgagatgtatttttattaaattcagtttaaaagattttctgatttttcattgagttgtctttctttactagtgcgttatttttaaatacattgcttaattttcaaacatattgacatattccaatcactttttcattattgctttccagtgtaactacaccatggtcaggagaacagattccaaattattgtagtatttcaaacttgttgagacttgctttatagctaagtttaaaatacattttggaaaatgctccgtgtaaatttcaatagaatctgagtgtgcttctatgctgtactatagtacttcccaggcatccttcaggtcaggtttctcctcaacctaatggatcttctgtatacttactggtctatatgattgcagaattttttctatttggtctactaattatgaaaaatgtgttttaaaatctattattatacatacattcatttctccttttacttttgtcattctgttttgtatatacagtcatgctccaaataacatttctttcaacaacagactgcatattcaacggtggcctcctaaggttacagtggagctgaacaactcctatagcctattgctgtctgagccttcataatgtcagagtgcggtgcattttaccttttctatgtttagctatgatcagatacacaaatacttactgttgcattacagttgcctagagcaggggtgtacaatcttttggcttccctgggacacattggaagaagaattgtcttgggccacacataagatacgccagcactaacaacagctgatgagctaaaaaaaaaattgcaaaaaattctaataacattataagaaagtttatgaatttgtgttgggctgcattcaaagtcatcttaggctgggtcacgggttggacaagcttggcctagggtagtcagtggagtagcatgctttctaggtgttgcctaggaatagtaggctgtaccatttagcccaggtgtgtagtaggttatgccatctaggtttgtgtcagtgcactctgtgatgtttgcacaacaatacatgtgcctgatgatgcatctcacaggatatgttcccactgttaagccaaacaccactgtatttgaaagttttgttgttaggtgtatacaagtttagaatttttctttctgaagaattgactctttcagtaggaaatgtctctttctagctctgatgattcttcttgccttaaaatctgtcttgtttggtcttgtcataatgcacaaaaattcttttggatagtacttaaacaaaatttttctcatctttaatttttagcactttaatggttttctatgtttatgtctgggattattttgcttctacttaaaggactccctcctttagtatttattttaatgcagatctagtggtggtgaatactctttattttaatttttttaggagtatctttatttaacctttgaaagggtttcactgaacacagaattttctatgggtaattatgttgtttaaagaagtcattgccatttcttccatttctgtggagaattcaactatcagtcttactgtaagtcttttggattgcagctgagaaaacctgttgttatttatatgatcactcacttgactaccaagatataacaaaactactgaaaggaaggaaaagtttgaagtgagaagaaaataaaagatgaataaaattacattacaataagcttagctacaattatggagagaaaaactagaatacagctgataaaacaagtaagtggcaccctattttgggtaaagttagtagtccaactgaaatctgattattagctgacaaaacaggtaatactccactgtcacttaatttgccataatattttagaaaatgccctttagtagaaagttatcatttcatgtttgcattagttgccacagatatataaacatgatattaggtaagactgcctaaaatcttctcccctgtatttttatggtaattatataatatagagcatgtgatgctctctgaccatatattgtgaatggtttttgctcttatagcagaatttaaagccagcacaaggacatatttggtgtaagaaatgtaataagacttgtggtcaaagttatgaatatttaaatgacattatatatacaaagaaaattatgctgttatttggtttcagtaaaatccagcataaaaattaattttgactcacacccaaatcctaaaatgtaaggggaactatttttaataatatgtatatttgggaaaataattgatttattaattggccaaatatttattgtgacaagccattttctttcattatagtttatttggtaagatgttttcttaaagagcctatgatgaatatttataatataactcaataaaaatgaacattagtttgtcttgcagggaagctatgacacgtatggatattacacaaaaatacaagccttaaggaaataggggatttggtccaccttgttctctgtggtatctctagcattcagattaaggcttatctcatagttaatgttcagacatacatgttaagtaaatgaattattatttttttaaatttgattttgtaacatctgaagtatgaagattataataatcagcattaaaatctggtttggagagacctgtattagaggtgtgtaaacattggtctcctttatttgctattaacatgtatatagtcagtgttgaatttaaaatgatgtaaatcttgagtgttcgctgaggttgactaccagtattttcaggagatcaccatgtggtatgatctgagatgtcttcagacctactttgctctaaaaagttatttacactttgcaatgtttgttaaactaccaagatctgtatattttcactatgtttgtgaagatgacagtttgaaaataagaagatgaaaaacaatatattacatatgtatgtttgggagacaaagataaccccaagtttagaaatgtgaggcaggcctatatttctctccaatagtattttatgattgtctccaattcctgcttggtttgaagtcccttaacgcagaataatttggtcagcagaatgatttagttagacagtaatgacactcttactccagacatatttaataaatgccatgtcttctactgtcttggcacaatatgagaatgtctgagtggtataaggtgcataaagtagtctgtttttatggggatcacaattttgttttctgcaaggaaaaatgaaagatatccacacttggttaaaaatgtattagaaatctgactctgaaaccacacagcaggattatgtgcttcggatccatatcttgacctactttcctaaaaatgtccaagttggtaaaactagatagttctgttatcttgtgaggctttcctgacgcactagttttgggttaagataatgatattactgttggaaaagagaagagtgattttttttttcctcttagaaattgtttttcattttatgtgttagctttctctctctattgggtgaaatgtccttgaggacagtgataaaggtttactctgtttataaaaccagtagtcaggcagctatgactgtgcgaaactctggacaggttattcaccagcttcagaagtggacttgtcctcccacctgatgattgatattggttaatctgtatccatctgtctgttggtctctctatccattcatccattccaggcattctataccataatatagatagataccatataccatgtaccataataccataccaaaatatagatagaaatgtaccataatataccataatatagatagaaatgtacttcaacatttctggatttattgttaaatttggtatgttattccttgaatactctgaacaaaataatagtaggttttatataaatagtagagactcattattatagctcattagataaataaaccttttaggttctattataaaataaatgtttcagtttctattcacaatgattaattcattcaaataaattataaagaaaaagatgagtttcttttacaaacacagttagaatcaaaattcaagtgctaagctgataacattctcattaatagcaataaagcctacagcacttattcaacccgaaaaataattgacttatcccagaaaggcttttatttgtagagtttaaatgtctcttctcataaccagcaacttgtacctcatataattactcagataaagaggctttcgattttcttgtataaaagaaaacactacagactatttaaaacaaacaagtggccgggcacagtggctcactcctgtaatcccagtcctttaggaggctgaggcaggttgatcacaaggtcaggagtttgagaccagcctggccaatatggtgaaaccccatctctactaaaaatacaaaaattagccaggcatggtggcacacacctgtagtcccagctacttgggaggctgaggcaggagaattgcttgaacccaggagtcagaggtcacagtgagctgaaatcacaccactgactccagcctgggcgacagagcaagactctgtctcaaaaaacaaaacaaaacaaagcaaacaagtaccaccaatataatactttatagtgaggatttcaaggcagcctatgttcctaatgatatagagttccagggagggaaataaatccaaggtctttacatataaccatggaatgaggatgtgcaagagaacacctgaaagaaaatcagatttcctataactgaaaacaacaacgacaagaacaacaatacccagcttctcaaatggttaattcacgtatggtaaagagcagagaatggaaaggtgctgatcacaaaacagttactaacactcccctcaccctccaaaaaaggtggtaatttatatttatcaggcagttatggaagtttcttaaaaagcaaggttatttttccttgcattatttacactgcaatatattttttaaatttatggaatgatgaatctgtttacaaaaaatgttttttatcacacgtaggatatttatagtgaaatgaaaatgaataaatcttgatagaattgagacactaaagatattttaaaaatcaataaatttctaagagataattatgtggtttgtatgataacataacctttaattattctcattttttctttttttttcagaccactcaatctctggctactccttaaacatgtgtctgtatctacagttttgctgatatagtactgtcagcctgcattttccaccatgtagtttattctaatacatacaagtgcccagtggctttcattacttctgttccatgtactctcaaattcaacatgtttaaaattgagctcactctgcctctggctatgcttccccagaggtggatggcaacagattccatccattcatccaaacttggaacctgagatttacctttgatctcaaattatacctgtttccccttatccaaacactaacccagtgtacacagatttttacctccttagtttttcttaacttttctttctttccatcattactgctgctttgctaatacaggccctcactaaatctagcattctgcctctagtcttattttctccaaatccattttccaaagaagtcttatgtatcaattcagtctcatgatatgactctgaagtgttttttttcaatggctctagattttcttcaaaattaacttccaatcttccttacctcgtgtgtgagagaagaaactggcacacccctttccttatctgcaagcaaaggtggggacgggaagaagttttaactttaaatcaaacaggaaattttgattatgttatatcatttgaataattaactgaaagaactgactgggaaaatcaggaggtctatctgagtttcagttatccccagaggaagaactaggcccaccaggtaaatgtgaggactcatgagcagtgaagaggctgtgtgatactttcatcccaagtgtggctggttcaatatgccagttacgtttgtgattttctatactcaatactgtttctgtacttcaggttcacagggtcctgtttgtgttgtttattctaatgctctctccttaatttcgaatgtgtcatctcattctcctgccttaattggataatcactcttcatcctttaacacagaaatagtcacctcactagttcagatcttggtttgtattctgcgtctttgtttgtctcatgtcttttgactgatgcttgccatcttacttacaatactgggttttagtcatgtttttcagtctgactgtcccatggtccatgaatgccttaaactcagggaatgtgtctcattcatctttgttattttcagagctgagaactgggtctgaaatgttagataatctgtaaacaaaatgaatgaaatgatgttgcagaggagagacatgtgggatagtcatcaacagtaacagagaggtggtcatgattattttccagatggctggggagctccaccttggaaggtccatctctaatggcaaaagactttttaacagggcttcctgaggacataaagagcccaattgttgttgaaatcgcatggaaagttcagcaagtgtagtatcgttgggatgctttgaattgcactctttgtctgttagaagctgaactgggcatccaggagttacaaagaacaaaaatatggcacctgtgctttggaacaactttgtagccacctgtcacttttggggaataatcgtcttctgagaagatatgttttattcctgagatacagagaacacagggaattctctcaattgcttaataataaaactaaaacaaaagtcttcttactctcaaccagactcatttggtctaagggaaagaaaatgactctcccgtgcttcatatgtgataaaatagcactgagttaactgttgtattgattcaatacacaaatagaaaatagaatgatttggctacagacaattcaagtatgaagattgcagttcctcttataaaggaagatgtcttgatactggttttaagtatttcttttaagaaaactctataaaaaccctgttttttggccaatattaaaaaaaggaaaaatactataaaattagtagcatatgtttcttttttcttttgaaaagctaccccagactagaagatgacttttagtaacactgtggctgtatatttatgtgtgtgtgtgtatgcacacatttttctatcaagaactatctctttacttttctattttcttatgctaccctttatttagttacttattttgaactttataagactacctgaagttttaagaatttcttttgttgaaaaaactcgggtttatcaccctagttattccaataaaaatgaagaagaaagcaaggcatcttagaaacagactataataaccattatataaccactagaagggaaatggagtaagaaactattttatagaattaacagtgcttaactactgtttcatgttatactaaaagcactcaacgtaaaataaaattaaatgacccaaccagcataaacatgccaccaaggttgagtaacaaggtgtaagggtcagactggttagggctgccttgagtcttaagagttcatctccaaagccgttgtctcgcccacctcagctttgcggtgacatcccagtgtgcagtgctcactcacggcaccgtcatctctctgagtgatttatgggctcagaagtcatcagcaaggaaactgcaggaagcccctgctgagaaccacgagcactgaaggaaaacagctgcacacatccgagcagattatttctttaacactcgtgtgaaacaaggcatcacgctggacataccgagtcttcctctttttcttttttttaaatggaaatatccttatctgggtgggtgaaggatggatatgacttcttaagtgaaaaacaaccgtttttgtggagctgctgaaaagattaaaacacactcatatacacactcagtttctcttcctcatcaaaaaatgagcaacaaaatagcttactgaatgtgcatgttcacacatgtacatatatttgcatatttaacttatttcgttgaaatcttttctctttctaaaagcaaagctgcactggaaaggaagactacattttatgagcaaagataaaacactctttgaatagtaaattgtttttaacaaaagaagaattcaggctaaaatgagaagaataatcagtttttgggaattttgccttttgtttaagttttttagtttatttaaatctttactgaactagaaaacaaggtaaattattctccaggttttctgcttagcatgccaggaagttctgggacattatttgaggatgttttgacaaacaaaatcatcccgatatggaataaagtcaacattcagtaacgcataattgaattttattttcgtggatgttagaataatgatatctatgtgttaaaccacaagcttcttgagggctttataatgtgtggttaggggactttccagctgccacagatcctgccagatgcttcagcattttggtttgttccacagttgaggaatgaagaaacttattccacagaagtgctgtcgccatgttctgacggctttccacagctgtgtcctcacatgcggtgtgtccataggagctctgtcaatcatgcacttgggcttgggttttaaaatactgatcacaacaacagactagaatagctacttttagttacatgaattagtaccatttggttgtgttttgagatttttttgatatggctatttatataaaattgtctcacacagctatcaaatgcacaggattaaaaatataagaccaaaataatatttaagtaagatgtaaaacatagcaaaaccacaaagttgtaaactcgtttccaaaagtcacgatagaatactgatctcattaacttcaaatggtgctagttatataaagatatgtatgcatgatcaaagcttaggcccgggtgcggtggctcatgcctgtaatcccagcactttgggaggccaaggcgggcagatcatgaggtcaacagatggagaccatcctggccaacatggtgaaaccccatctctactaaaaatacatatcagctggacgtggtagcacgtgtctgtaatcccagctactcgggaggctggggcaggagaattgcttgaaccatggagtcggagcttgcagtgagccgagaatgcgccactgcactccagcctggcaacagaacaagactccatctcaataaaaaaaaatatagcttagatatctctgccatgaacatatgtaatccaaataatcttttcggcaaatgtgtgcacagggaatatttaaaaactcataatgctcgtcaagaggaaattaatttccacttgaactaagccaacgtaaaagtcaaaaatgccctttggaaatttaaacacaaaacaaaagattgtgcgtaaggagtgaatctgtatatataagaataatcttcaacatggtctaaacgttctcttaatacagcccggtttagtgaataacttagctgcgtgaccttgggtaagtcatttagtttcaatgttttcacataaataactgaattgtgagggtatattgaggcatgcatttcgtagtactttaaaaaataatgcaaatttatgatacattattttaaacgttattataaatgcttacattatatacatatgcgttatatatgtatatagatataacagctgcatatctaatgatgattatactcttctatttctacattaaatatatttttatgtgttcttttgaaaagttcgattactagaactaacaatatttcttcattttatgagatggttctcacattaaaggaagaaaaatgccacgacgtctttctcttcagtagtaggaacaagtgagagaattaattgttttaaaatgactgttgaagaatgatgagaggctctctgtacaataaacaagccaaactcaaatatatggctagagttctgggttgttaatgcacacactataaacttttatgttgggaaatcaagctagtgatgtccaaaaatcatttcttttttagatttccagaaattcatgaccaagaatggtttagctcatgtgcatattacctttggacacagatcaagcaaacaaatataaaaaaccaagtgaaaaatgtttgtcaggctttgttaaacggtgaaacaggatacagtcttattttaagagcagacgaaaatttgcattttatttcaatttgccaaaccaatttttgtagaacctcatcatagcaacattcttgtggcaagtaaagtcagcatgttgttcctatcagtagagggggaatcagaaacagattctggacatattccaatttcaaggggttcagaaagaaaattaaaattaaacttcaaagctgaagtgctcaagactaaactagactaataatacataaagtggaaaattaagtaattctaaatgtcatgggcatgtgaatatcactgactcatctttaattttatagaataagttagtgttataagtgacgagattaattcaagctgactaacacaggttgatcattttgttatttatgcttttgtttccctcttttatttttgttaacaagcttagtgcttggcaataataaatgggtagctcaaatattatcttctctaaaaaactttgttgatcttttctaaaaatacatacttggtttattcacacttctatgacaacccttttaactctgctttaaagtttggattatatgtctatttctctgtggttttttggagtgcaaagaccatgttccctgttggattttccttttctacacaaagtatggtatttggcatataaacatgttaaaagtggtgaacaagcatttcacaaaagaattaatgagtgaagcagtaagtgggttcatagcaaccctcagttgttgacgggatcaactagattattacaagcaaatcctgttgtttcattcattcattctacaaatattgatcaagttcttggtataaataaaatacctggatccatagctgttcatcagcccttcatttaaggtgtcatccatgggagtgaagatgagagacaagaaagtggtgcctgaaagctcagcagttagggaatttgaggccattctaggttctaaaaacactgtggtgaccttagcgcttaaactttctggttttcagtttcctcatttgtaatacgaagggatggccttaatggtctttacattccctgtaagtttaacattttattatgatgattgatagtagtactgctgaggcacaagctctgcagggtcctcatcacatacagcctgaggcaggggtatagaatcattataaggatatcagcactgagagactataattctaaagtcatgcgggacgcaaaatacagcagaggtggcacagaggcagagaggaggcacgtggaggtggtggggtgtgtgtgtgtttgtgtgagagagagagagagaaagagagagagatggagagaaagtgtgactgttcaggggaagaatttgtaaaacatgacactgaaactcagtttttaaggatgaattctgcaggggcacagccagggggtgggtgattccaaatgtcagaaacagcatgcacaaaagcatcgagtttagaaacagtggggcataaagaaaattggaagcacttaggttttgttggagaatgaatgtgtttgacaggttgacaggttggagactggaactgtaggtaagaggctgacctaaaggctctggattccaggcctgagggtacagactgcagtctatactcagagagagatgacagatgctggtttcaaaagctcgtggcagctgctgtggaaggcggaactcaaggcagtaaaactaggagcagtgggccttttgagagcaaactgaggtgagaggtgagatccaggtgagagagggaggggtaagagacgggtaagctggagcttgggcagtggcatgtaaaagagttcctagtgaaggacatttaggaggaagaaccaatcgatagcatttggtaatagactagcatcaatcatcagggaagaataggaacttttttaggttgtccaagtgaggggagatgattttcttaacagataccagccacatggaagcataaatatacctgtggtagaaagatgatgaatttggttttggatagattgaatttgaagtgcctttggggcattcagaaggactagcccattgcgtttagaataacatccagaagccttactagcctggccctgaaagcccactgctgctgctcagccctcatctcctgccgcgccccttcatcctgcccctggccactccaccgttcctgcaccccccgatcccctaaaactagcccgcccctgagttttgcacttgccgtttgctccactggcaacaatgtctcctcaaacatctacagggctggtttatgtgtgttcagcctgtttatggagtctccgaagatcatcttgacagagtccccttcggagaccatcccaagctgcatggccctgggcatttctgtcgcgccgtgttttattttccgcaaagcttatacaactatttacggtgatcatggttattttcgtattcgcttgctctctacttgagggaaaagctctgtgagaacagagaattggtttcgcttgccgttgcgaccccgcacctagcacagtgcctgatgtgcactaaccgcgctgacggttgagtaactgtgcacctgcccgtggaactgtggagagagccggcggatacgcaggtgcagcagagcaggacggacggaggagcgcatggacttgcttccattgttcaagcgccttcatgtagtcagatattgctacaaaataagatattttaaccacaactggttttttcactctgacttcccctcttccactcatctcatgttagttgatatgaaaaagtgtattggggacacagctaatgagacattgaattagaatacattagatttggttctaataggatgtatttgtacaatttgcgacatacataatcataaatgccaaattacatagagaaatgcatatttatttagaacgagaagagaaataataatactagcttttgaaaaactaacaaatatctaatcttcacaaagtctagaaaatcacgtgtttttatgttgttttgccggatattgttccatagtccttcttttcctatgtttttggctgaatagtatttaatctcctcttccaatggcagcgcttttgtaatgtcactttctataaaaaggaaagataattctatttttctactagtatggttgatttattttaaacagtgtttagaaaagtatttttagcattataacttgttaatgaaacataaaaatttcaaggattgttttcaaatttaggaaaaacttgttttttcttttttttgttgctgttgttgttttcgagacggagtctcgctttgtcacccaggttggagtgcagtggtgcgatcttggctcactgcaacctctgcctctggggttcaagcgattctcctgctgggactataggtgcccccgccactaggtccggctaatttttgtatttttagtagaaactggtttcaccatgttgtccagggtggtcttgaactcctgacttcaggtgatccctcctcctcagcctcccaaagtgctgggattacaggcgtgagcccccatgcccggctgatctcgtttttcacacagggtttgttacttacatgcttgctgtttttggagctgcttcagatttgtgccctacacatgcagtaattctgataaattctattttatgaaattttccaccaaagttaatgtactgatttctgtatatgctttattatatcatatatttttgaaaagagagaatttccattacttgagagaaaattttcaattcatactttattcattcaatttttaattatgtacatttcaaaatgtatttcttttccattccttgcatgcgtccggtgacaggtcccccaggacattctgtcttggccttgcccctttgtcacagtggaatacaattcagctgagaaaaggagaaagtcctgtcagtcacaaaaccatagatgatcctggaggacattattctaagataaataagccaggcatagaaacacaatactgtatgatcccacttaaatgtgggatgtaaacaagtcgaacccatagaagcagaaagtagaatggtatgagaatgtgtcggtcgaagtgtacaaagtttcagttaggagaactatattctggagatctatttggcggatgtagtaacaataatgtactctacccttgaaaattgctgaaagtaggttttaaatgttcccacaacacaaaaataagtatgtgtgatatgttaattagcttgatttaattatttcagaatgtacacatatgtcaaaacatcatgttgtatcccataagcatgtacaataaaaaataatttaaaacaatgacaaaaatccagaacacacaaaatacctataaaatataaataaaaatataatagccaggcatggtggcatgcctgtgatcccagctactctggaggctgaggcaggagttttgcttaagcccaggagttcaaggctgcagtgagctgtgatcatacaactgcattccaggctgggtgacagggcaagactctatctcaaatatatatatatatcatatcattatatatgtgatataaccataaactataaaatatacatttaaaatattatatatgtaaatatacatttatgaattacatttgagttcttgctgcccttttttttaatggcagcatctaaaagactggaatttgtccaagtagaaaatcctacttttgttaaccattacttggctgaatgtcaataaatgcccatggtatgagaacatggttgtttataagaaatcatcaacagataactgtatatttataaacagttaacccttaaacaacatgggtttgaattgcatggtccactcataagcagattttttccctctctgccacccctgagacagcaagaccaagccctcttcttcctcctcttctgctcaatgtgaagaagatgagaattaagacccttgtgatgatccacttccacttaatagtaaatttatttcctctgtctctctctttttttttttttttagttgtggggggtctctctattttgccgaggctggcctcaaactcctgggctcaaatgatcctcctgcctcagcctcccaagtagctgggatgttgaagcaggtcacaggacatcatgcctggcttccttgtgatgtttcaaaataacattttcttttctctagtctcaggttttttgtaaaagtatagtgagtatagtatgtaatacatataacatgcaaaatatgcattagtcaactatgttatcagtaaggctacaggtcaacagtagactattagtagttaagtttttttttttttgtcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactaagaatgatgatttccaatttcatccatgtccctgcaaaggacatgaactcatcctttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtcaatttgtttgagttcatcgtagattctggatattagccctttgtcagatgagtaagttgtgaaaattttctcccattttgtaggttgcctgttcactctgatggtagtttcttttgctgtgcagaagctctttagtttaattagatcccttttgtcaattttgtcttttgttgccatttcttttggtgttttagacatgaagtccttgcccatgcctatgtcctgaatggtaatgcctaggttttcttctagggtttttatggttttaggtctaacgtttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagcttcgttcttttggcgtaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatcttgattcttcctacccatgagcatagaatgttcttccatttgtttgtatcctcttttatttccttgagcagtggtttgtagttctcctcgaagaggtccttcacatcccttgtaagttggattcctaagtattttattctctttgaagcaattgtgaatgggagttcactcacgatttggctgtttgtctgttgttggtgtataagaatgcttgtgatttttgtacattgattttgtatcctgaaactttgctgaagttgcttatcagcttaaggagattttaggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgctgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttggttggtaaactattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctatgggatcggtggtgacatcccctttatcattttttattgtgtctatttgattcttctctctttttttctttattagtcttgctagcggtctatcaattttgttgatcctttcaaaaaaccagctcctggtttcattaattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgcgtctttgttctcgttgatttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggagagttagctcttcttgttgaattgatccctttaccattatgtaatggccttctttgtctcttttgatctttgttggtttaaagtctgttttatcagagattaggattgcaaccctttttttgttttccattggcttggtagatcttcctccatccttttattttgagcctatgtgtgtctctgcacgtgagatgggtttcctgaatacaacacactgatgggtcttggctctttatccaatttgccagtctgtgtcttttaattggatcatttagtccatttacatttaaagttaatattgttatgtgtgaatttgatcctgtcattgtgatgttagctggttattttgctctttagttgatgcagtttcttcctagtctcgatggtctttacattttggcatgattttgcagcggctggtaccggtcgttcctttccatgtttagtgcttccttcaggagctcttgtaaggcaggcctggtggtgacaaaatctctcagcatttgcttgtctgtaaagttttttatttctccttcacttatgaagcttagtttggctggatatgaaattctgggttgaaaattcttttctttaagaatgttgaatatcggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgcctttctacattggggaagttctcctggataatatcctgcagagtgttttccaacttggttccattctccccatcactttcaggtacaccaatcagatgtagatttggtctcttcacatagtcccatatttcttggaggctctgctcatttctttttattctttttctctaaacttcccttctcacttcatttcattcatttcatcttccatcactgataccctttcttccagttgatcacattggcttctgaggcttctgcattcttcacgtatttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccattgctggtgacgaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgagatgtcagtgtgcccctgctggggggtgcctcccagttaggctactcaggggtcaggggtcagggacccatttgaggaggctgtctgcccgttctcagatctccagctgcgtgctgggagaaccactgctctcttcaaagctgtcagacagggacatttaagtctgcagcggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggtgggcgcccctcccccagcctcgctgccgccttgcagtttgatctcagactgctgtgctagcaatcagcgagactccgtgggcgtaggaccctccaagccaggtgcaggatataatctcctggtgtgccattttttaagcccgtcggaaaagtgcagtattcgggtgggagtgacctgattttccaggtgccgtcggtcacccctttctttgactcagaaagggaactccctgaccccttgcgcttcccaagtgaggcaatgcctcgccctgcttccgctcgcacacggtgcgcgcacccactgacctgagcccactgtctggcactgcctagtgagatgaacccagtacctcagatggaaatgcagaaatcaccgtcttctgcgtcgctcacgctgggagctgtagaccggagctgttcctattcggccatctttgctcctccccccttagtagttaagtttttgaggagtcaaaaatttcaactctgagtcagtaacccccatgttgttcaaggatcaaatgtatatatttccatatgtgtgtttagatacatgtatgtgtgtgtgtatatattcatgcatgtgagcctatgtgcgtgtagactattctctaaaactcaaaatcagagaaaaataacctttgtgtaaagtaaaatatatcaatgaccataatcagatatgaatcataattctaatatgtagttgacgtatagaaaaaagcataagaatttgtattgatatgtttatttaaattaaattataaaattgcatagagttagaaaaagcaaaattagtttattgcaattattattttctcaacttgatattaataaagttatttttataataatggcacatattaaaaagcaattttactctgtccttcagagcatttgctccacattggagctatttccattgtagatttttttgtaaggctataattctatcacatgggcagattgtgctaaaacaagcagaaagggtcacaaccttctgtctaacctttgctatttagaatgaacgcccagggctttcgagaatgtaaattgtcctggcctgttctctgacaaaataagaacatacagttgaagaattattttttgtaaaacctaaatttgccttttttcctcacactaagctcttctcaagtgttaagtttaaagacagttaattatcagctattctttagagcacgggaaaaacagtttagtactcagtaaagtgagcatgcaatctaccttattcctgtttttttcgatggatgaatgtgaagaatttacacagtcatgcaagagaggcaacgatagtgttctcttaagaagacaaaattataagattggaggttaacacttgctcaacccagtaaaaaggcatttggtagatatttctgatctttccctgactgatgaaaagtgctgatatttctaagaaactggtaggaaactttaaaaaaaaaaaactccccgaagcctaccaccaggcatgccatgaactttcagatgacacatcgtgctactaatttttagtgacctttgctaaatttatcaaaaaatgctctcactaaatccatttctgtagaaataaagaaaatatccgtgatgtgcaaactcacagtacaaatctgtgcggcttctgactgcaaaagatcctgcatatttcatcaaagcctcagggttgtggttattgatgtttcccagaacgtggagtgaaaccccacacaaacagattgccaaaggggagaaaactatgatttgtgaaattcaacattatctcttgaatgcctttgctttttattttgaacatactttattttttagaccagttttaggatcacagcaaaattaagcagaggtatagagatttcctatatatccactgcccccatacaggcatagcctcccccattatcaaaagcccccacaagagtggtaaatgtgttacaactgattaacctccattgacacatcattctcaccccaaatttaccttaggtgttagacattctgtgggcttggagaaatgtataatgatgtgtacacacaattacggcattatacagggtaggtttcttgtcctaaacgttctctgtgctccacctattcagtctccctctctcttaagtctgggcaaccattgattatttttactgtctccatagtttgcctttaaaaaaatgtcatatagtggctcacgcctgtaattccagcactttgggaggccgaggcaggcagatcaacgaggtcaggagttcgagaccatcctggccaacatggtgaaaccctgtctctaacaaaaatacaaaaattagctgggtgtggtgatgcttgcctgtaatcccagctactcagagggctgaggcaggagaatcacttgaaccagggagttgacgttgcagtgagccgagattgcgccactgcactccagcctggcgagagagcgagactctgtctaaaaaaaaaaaaaaaaagtcatatagttggaatcgtgtattatgtagccttttcaatttggcttttttcacttggtaatatgcatttaagtttcttccacatgattttatggcttgaaagcttatttctttttaacgctgagaaaatttccattgtctggatgtacaacggcttattccttcgcctattctaggctatctaaatttcttctaagttttagcaattatgaatagaaatgctctaagtgcaagtttttatgtagacatgttttcatcttctttgggtaaataccaaggagagtgattatagtatcatataataaaagaatgtttagtttggtaagaaacggtcaaactctcttccaaagtgactgccattttgcattcccatcagcaacgaaagagaattcattgttctttaacctcactagcatttggtgttggatctggagcttggccattacaataagtgagtagtaatatctcattgttttaatttgcatttccctgaggacgtatggtatggagcatctttcacgtgcttatttgccatctgtatattttctttggttgggtgtctatttaggtctttggaccattttttaattaagttttttttttttatcgtttagatttaagggattctttctatattttgaatagcagtcccttatcagatatggcctcccacatgagaatgtaattcttctgacagtgcctctcatggagcagaactttttaattgtaatgaagttcagtttatcaattgtttctctcagagattatgcttttggtatatctaaaaagtcattgccaaactcttgctaatctagatttttctcctatgttatcttctaggagttttataattttgtgttttagaatccactttgagttaatttttgtgaagagtataaggtctgtgtctaggtttatttatttttgcatgtggatgttcagttgttatagtactatttgtagaaaagactgtttttgctccatcgtctttgctcctttgtcaaagatcagttggctctatttatgtaggtctacttctgggctcctcattctgtttctttgacatgtttgtctgttgttttaccaataccacactgtcttgattactgtagctttatagtaagtcttgaaatctggtaatatctgtcctccagctttgttattctccttcaatattgtgatggttattgtgagtcttttgcctttccatagaatcagtttgtcaatatacactaaaataacttgctggaattttgattggggttgcatttaatgtatagattcagatgggaagaactgccagtatttagcctctctatccatgaacatgagatgtctctatttatttagttctttgatttttttcatcagagttttgtcattttcctcctataaatcttgtacatattttcttagatttatatcttcggtatttcattttgggtgtgctcatgtaaatggtattatgcttataatttaaaattgtacttgttcattgctggtatataggaaagcaatagggtttcgtatattaactttatgttttgccaccttatgataagttagtttcaggaggttttgttggtgttattaagttattgttgttgattatttttgattttctacataaataatcatgtcaactgcaaacaaagacagcttttttactctattggtgtgttttatttatttattatttatttatttacttatttatttattttctcattgcattagttagggcttccagtgtgctgttgaaaagaagtggtgagaggtaatatccttgccttgtttttcatcttagcacaaaagtttccactttctcaccattaaatgtaatgttagctgtatgtttttgtaaatatcacttgttagtctgaaaatgtctttttattattattattatactttaagttttagggtacatgtgcacaacgtgcaggtttgttacatatgtatacatgtgccatgttggtgtgctgcacccattaactcgtcatttacattaggtatatctcctaatgctatccctccccactccctcccaccccacaacaggccccgctgtgtgatgttccccttcctgtgtccatgtgttctcattgttcagttcccacctatgagtgagaacatgcctgcaggttctgtccatttgtggtagagggacattaaagtgttcaactataatagtgaatttgtttctctttgtggttctatcagtgtttgtctcatagctctaatgtctgctctgaattcacataactactcctgctttctcttgactaatgttagtatggtgtatttttctctatttatttacttttgatctataggtatctttatatttaaattggatttcttgcaaacaatatatagttgagtcttgttttttgatccactctgccaatttctgactttcaattggtgcatttagaccattgatactccaagcgattactgatatagttggattactgtctataatattttttattcttttctatttgttgccctttgcttctatttttgaattctacttctttctgcttttttgtagcttgagtttgttttttattgaacagaatgaacaagaagttgttggctcctcaaaatcaattattatttttatatcaaactggaaaattaaaactaaacttcaagttttatcagcttgttatttgacaagtacttttttttcccaggcactgccctttacatctaagccaatgggttttctatctatctgtttcctactttctagtttaggttttaatagtttttaaatctttgtggttattattgatattctcaatttttactattaaaatgaagcattatggatagtaaagcatattttgaagaatttctacggtgattaaaaatttttctattttgtaatatggtgttatttttacatagaaaaacacctgatacttttgagacctcagttatctctcacataaactctcactgaatttatctgtacccaagtcatggtgttaagaagtcttgctgtgaaatgtagaggtcagtcacatacatgttgaaatacaacagaatgtgtgtgggttgcttccgggctcttctgcttaccagctgtgtgtccttgcacaagttaactaaattcttgcctgtcagcttctcatcagtaaactagggagtataaagacaatccatagtattattgtggatgttagctaaaatattttaatgcaaagtatcaattaaaattttttgaaatataatagatgtcccaaaatgctggcttaccattcattattattttaatctttgcatttcagtcttttgtgatactttctccaacatacaacagtctagaatggaaatatgggctatatttttgaatttctaagcattttacctggctattagtatgaattcaagaagcatttgttgaaagaaaaataagattctcaaattgtaagcattagtgcaaacatttacttggccactaagaaaatttaataattaattaatatactttagaatttgtttcaaaactctaaatgtttatgataaaactaaactttctggtatttggatttattcttaataacttcttttcctacattgcctttgtgaagttttctctctaataagccacctttaaagtttgaaactgcagaatcacaaagtgtacacttgctgcatactgtagagtccttttggttgcaccaaatcctgttgagagttttaccattttaataggcatcagtcagcgtctgcaaaaactttgcacacatgtaaagctgttgctgaaatcttttattatctggagaaggaaaagcactaattttttcatgccataaaattcctaaaaatgatgctctgatggtaacataatgccctatatgtgagtaccatggttatagatttaatctaaaatatgaaatcatcaatactatacagccaatatcaaaaacatgttgatcaatccataaaagatatgttgatcaataatgatcaaagcttaccgataccaccgtgtccagtgttcattctaacagcacagcacaatggttccagacaattacctagtcttgttctccatatcaagtggagttattagccaatgggtgaaaattttctgttaagcaagatgaataaattctagacatcttctgtatagcattccacctataggcaaccatattgcactgtacattgaaaattttgttaagaagatagatcttacgttaagcgttcttaccacaatttaaaatagttttttaaattagctagtaaaccttttttatggtctagatactaatttccaaatataaagatggataatttaattgtctttaaaatttaagcccaggtgaagtgtcaagaatgtcagcatttatttctgtgttgacaaatcagaacataaacataaacaaatcaaaacatcaactacattcaggtctccaactttaatatcaactatctgttaattgattttaggtccacatctttgtccacaatggcacatttctaaacgcatcatctggaattaaaactacttacctactctctatacagttgccacttaacgggaatttcctggttgggtcaggaatgtgtttattcttatgcattctttgcaggctgcattgcccagagttcaatctggtttcatattgtgaagcacaggggagagtgggaagaggtaaatattccctacaccttcccacccatccaccctgaccctatcctcttccccactgtctgagggctttagacagtggctacatttttccatggctccgtccagaaaggtccactgttacttcagttttaaccaaataatccctgcccctgagctctggtaaatgcctcttctctttgctactctggcctcggagaaataattccttactgggattcatgatatctgggttttctctcagtgatttcactggtgtctcagcccttccattacccttgcagccagtccccaactcgaaattattgttgtccagggaactcaaacaactcaacaagaaaaaacacaggtagccccattgaatagtgggcaaatgacatgaacacatatttttccaaagaagacatgcaaatagtcaacaagcatatgaaaaactgctaaatatcactaatcagagaaaaatcaaattaaagccataataagataatatcttacagcattaaaaaatatggtggtgaggatgtggagacaagggaatgctttgtacactgttggtgggagtgcaaattagtgcaacctctatggaaaacagtatggagatttttcaaagaactaaaaatagatgtaccatttgacccagtcatcccagtactgtgtatctacgcagaagaaaagtaatcattacaccaaaatatacctgcactcatatgtgtactactcaaagcagcaaagatatggaatcaacctgagtgtccatcaaaggatgattggataaagaaaatgtgttattatatatatatacacatatataaaaacacattttcgtgatatatatatatatatatataccatgaaaaaatactcagctataaaaaagaatgaaattatgtctttttcagaaacataagtggaactggaggcctttatcttaagtaaagtaactcagaaacgaaagtcaaatacggcatattctcacttataagtgggagctaaacaatgtgtacacatgaacatagagagtggaataatagacattggaggcttggaaaggtgggagggtgggagtggggtgaaggatgagcaattacctctcgggtacaatgtgcactatttgggtgatgattacactaaaagctcaggcttcaccagcacataatatatccatgtaacaaaactgcacttgtaccttctaaatctgtaaaaataaaaattaaattgtccttatttcaaatgcagtaggtggtttctgttttgtttttgtgtttttgctttttgacaaaattgcgatatatatgcgctgtataatgatatcctaggagtcacgtttctggatctactttttcagggtcatttctaagcattgtggattatgtatctgttttagattgaaaatactgaaccatatagctttcatgggatttgagaatgaaatcatgttttccctaagaaatgatatcttttcttctaaaaacacaaagcagtctaactttgataattaattctaatatgcattgggaacacatgcataggtagatggaaagtttgatgaaatgctaccatgtgatatatgattttcatatatatctcatttattcttgcaaccactcaacagggatattatgtaacataacttgctgttgtgaaatctgtaaaatagctacaaaccaaatccaaggctgtctgagtccaaagcctagaccatttctactctgtaaaactatttcttcttcagagaaaatatttaaaacaacagtgacagactatgaatgttcaatatgtataatatggaaatttgtctcttttttctttatttttcttgctgtattagaaaaactccttgcagcgttttaagattaatgttcctttccctctaggaaagaggatagagcaaaacaagttttgttttattaatgatttcagtcctggatttaataaattttaaacctacactatgaaattaaaagggatgatgcattttgggatgaggatgagttagaggtagaatgacataaagataaagaagtgaaggaagtttatcaggcgtgaaacagaagcctggggcacgatgatggggaaggtttccaagtgggaggagctactgattagtgagtccagagggtagttcccaggaaggagcaacgtacatcaataaggaggttcaaaaacaaattgtctgtacctggtaaggacagaagtacaaattcattggtctgtgttaaaagtcttgttccttatcaaaatgcaatctatagagaacttcgttaatctggatattaggcaggcatcatgctgattcactaaatgatgacatcatctttatgagccttgataaaataaagtacaaataatccaaaatgtcctggaaatatacatgcatcatggaagatggtaggtaaacttcatggagaatcaggggcttgacaaattgatgttcttagaggattgaggtatgccacaggtagggaagaaacggttgcatgttgcacctccagttactaaggcagaagcccagatcttcatggattttggaggtagcattatttattgggtgatatggtttggctgtgtccccacccaaatctcatgttgaagtgtagctcccataattcccacgtgttgtgggagggacctatgggaggtaattgaatcacgggggcagttttcccccatactgttctcgcggtagtgaataagtctcatgagatctgagggttttataaggggttttccctttctcttggctctcattctctcctacctgctgccatgtaagatgtgcctttcaccttccaccatgattatgaggcctccccagccacgtggaactgtgagtccattaaacctctttttctttataaattacccagtctccagtatgtctttatcagcagcatgaaaacagagtaatacattgggaacttggaaactatcagttttaagtggaatccagagaaacagagggctgtgtagcacaatctgttctgcctcttaagccacatgactcagtaaatccagagatgctagatgtatctgtaatagataatgaagctacatggagtctctgacaagcccaaatataagggttgcagaacagacccatagggttttagataaaagccatgccttccttagcgtgcaactggaccccagcagactgagcaccgtaatgcgggatatgaagtgattttccaatcattctttcctcatgagttggatatgttcagatctgtcaatttatgacactgagggtttgcaacatcaatatattatacaatatttgatgggaaaagtattgtactgatgtttgtagttgtgtaacaaatcaccataaatttagcatcttaaacaacacgcatgtattatttcacagattctatggatgaagagtgtgggcacagattaactgggtcttctgcttagggtttcaatggctgagaaatcaaggtgttgactagactgttttctcatctagagtttactggagaaaatccacttccaagttggaaaaattcatttccttgcagtcacagggttaaggtctccagcttcttgacagctggggctgggagccaccttcagcttctggaggctgccagtagttctgagaagccaccggcaattcctgccaatggccacttatacttcatcaagccaataaggagaatctctgtgacaagccagcctgcaaaacagggtaatatactgtaactatcatgtgagtgacatctcatcacattcaccaaattctatcgattagaagcaagtcaaggtcccattgacattccaggggatggaatgaggcacaaggcattcagcaccaagaggtggagatcatgggggcatcttagagtctgcctgctacagataaattcagagttaggcctgaaaaggtccagaagacacaagtaagttgtagccatgagtagcccaggtgcaatatcatatacctcagtagcaccagtgtcttctcctcagctaaggaaggtgtcaagagagacatcttatgatcaacctatggaggaagaaaaaatttgtggtattttgcatgtcggctcagggcaaagagtgcattttagaataaaggaggtgtggcaacgtgtgtgcatggccgtcagatgcacagggctaagaagcaactgctagaaaggtcaaatagctgtaataggttcagctcatgtggaacttgggacactgctctgtatgtttgagactctctcctccagaaaacagaatatttactgagccagcagtcaatacatggtgctgagactgacatgtctagaaaacacaggtctcaggaccacagggtgaaagagttgccccctcaccatcacacgtgagtatccacttgaagaatcactgtgttttccagtctcacaacattaggctctcctggattagggataatggttcccaagaaagaactgcttctatagggaatatagaaagaattccacataatataaagttacttcaagttagaactgctgtctgattactttgggtttctcatactaacgtactcagaggcaaagaaagaagatactcagctaaggaggtaattagtccaggttattatgagagacagtgacaaatgtagaatccaaaaagactaatatggccatctcctgttatttatctgttcagtaagaacaatgaacgggcacttatagcagtcatggtccagtaagaggaagaaagtatggattcaactctgtaggggtgatggtttgagtcaacgcaacagaccagcaacccagaccaaacaaagagatctgtcattcttcctgtgagtgacaccggaactgctctcgttaaccttacactgttcgtctctgacttcctgttccagacttctctgttggcacattgagagtaatgtcatggtgagctgctgtgcgctcaagaatgtgctacctggaggtttgggaagttaaacctttagagaaatcttttgaccaaaggaacttgggagaaaatggatacacattttcctataacttctccagaaagtcttgagacatagtccatagacttccgtaggagatcaacgaaatgaaggaagcagctgtcgatagttgtggctaacgtaaaaatgtatctctatattcagcctcccttctcccctgttttgttcccctgcttcctggattccactcctcgataaaatacttgcccttaagcctttgccttagctctggtgtctgaggaattagagctaagatactgctcattatgagaatgtcaacacccacgccaagtctactaattccagatgatctaaaattttaagacccttagggatccagttcactggaggattctactcaaaggtatagagaaaggcctttgttcaagctgcacatcacattttgttaattaggcatggaagtcactctcctcgtacccaaggtctcacatgtgctctcctaacgtactgattagcatccaagcaaaaccacaacccatcatataccactttaagcttctcttcccccagtggtattattgctctgtcctaattacgtgacaacaaccccacggatttgaattcaaatggcagcaagcggccaaaatgccaatttcttcatctactaatctgtacttctatagtttctctccgaatgttttcttcctccattttaaagttatatttctgtacatgaataactccattatacagttaatatggtaaaggaaacaaactctttcttatgtcaatgacacctttaatactttttttatcattcctctattttaaaatcttactacattttcctttttgaaggtattattttcccatatgcctacagaaaatatgcccattggcaaaataatgcaaaatgatgaagataataaaacaaaataaagaaaataaaaatccacagtgttcttgtttttgagccatttctttgaatggatacttagcctttgctattacgttattatgactttaacaccatcattgaaatttgcctggctgggcggggtagctcactcctgtaattccagcactttttgaggccaaagcatgtggatcacctgaggtcaggagttcaagaccagcctggcaaacatggtgaaaacccatctctacaaaaaaatacaaaaaattagctggccgtcgtggtgggtacctgcaatcccagcgactcaggaggctgaggcaggagaatcatttgaactcagcaggcggaggttgcagtgagccgagatccatgccactgcactccagcctcggcgacagagagacactccatctcaaaaataaaaaataaaaaaagaagaagaaagaaaagaaatttgcctatcactgagaacagttaatttcatacagggtcataacacgctagatgattgcactgttattattataggtagataacagaaggccaggacattagtctgttttgcattgctataaaggaatatctaaggctggtagtttattttttgtcttggctcatggttctgcagactatccaggaagcatagtgccagtgtctgcttctgtgaaagcctcaggaagcttacaatcatgacagagggcagagggggagcaggtgcatcacatggtgagacagggagcaagagaggggggaggtgccaggctcttctaaacaaccaggtctcgggaagtaagaactcataactgcagggagggcacgaagccattcgtgaggggtctgcccccatgacccaaacccctcccaccaggccccacctccaacgtcagggatcacatttcaacatgagatttgcaggggacaaacatccaaactacatcagcaagttctggactaaagtaagacacatttggtttgacgcccttccattttatttttaatataccctcttccaacctaacagacatcaacccaggtctcgttttttcctgatcagattggggttttattttaaaccaagcccatgttaacagccagttttttttccaaggaaaatatccccattattagctatggccaggattttctgaattctctttcctatttgcactttgcatttttactggggcttctctgcccttcataagaggcgcgcatccttagtggggcactgttaaagcagccgcgtctccctcagccctggctacaggcagcaggtgtttcttccatcttatgcccatactccgcctccttaggctttctacacaagggaccttaagtggaagcccacactcttcttgcaatcaaagctttctctttttcctgaggttcactgatgttgttgattctataatcttttgtggggttttaatttgtgataatgtaaagtgttaggagtcccccaaagcatttatattatgagaggttgttcccaaatatggaaacgtgttcaactcacagtatgcatttctaatggtagaatttacccccctttagtaggtgggtgctgtcaaaggggagtacatgtgtgtctatatggctctgtgtctgtccttgtctacctcacttctctacttattatctatccatttaccacccattctaaatagatctgatggtaatgccagagaagagacattatcatattttactgaataaaataatgagaaaaagcggggttgaagtcacatcacagaccgagaaaaacttctagagtattactgtgcagaaaatgcagtggactagaggaaatttagccagtacttctttctttatgatcctattattttcactacacagaagccagttttctccctgctttttcacttggtaggatttggccagtgtctgttagaaatttggttaaagctcaaacaagtcggattttcaaaagcaacctgaaggtcagctgtttagttttatgcatttccttcttctctgaccaaatactgcaagttctgccaataggcaaaggcaaagataatgtattttgtatggcctagttttgtatccatatgaaatactatagacttgtttgaggttacagtttgaatattaacaaaaatcaataaagctaagatgtactagataacattcaaagtccctttgaaataagaagaaatgctcaggaaaatctaaaagtaaaatatttatttttctcaattgatatttccataagtcatttttattttttgctcttaataaagaaaccataataatgtgagaataaagtgaaatcagtggtaccattattgaatacttatttaataccccctcactacaacaccaccccaagtcccattgctcaaagacaaccacttttgtttctctctctggtatttgggaacacatttattaataatataggtataatgtaattttctattgagtaatttacatgtttaaccattacaggcattttgctttcctgttccaatggataaaaattcaactctcctgatagaaatttcaaagacagaccaggcttggtggcttatccctgtgatcccagcactttgggaggttgaggcaggcggatcacaaggtcaggagtttgagaccagcctggccaacatggtgaaaccctatctctactaaaatacaaaaaattagccgggtgtggttgcaggcacctgtagtcccagctactcaggaggctgagacaagaatcacttgaacctgggaggcggagcttgcagtgagccgagattgtgccactgcactccagcctgggtgacagagtgagactccatctcaaaaaaaaaaaaaagagaaatttcaaagagaaaaagacaaatcacctagccatgagttagatttgttacatcataacatttcagtgttagattggattttccattgtgtctagttcacccagccatctaatgcttgaagtttttctaatcactcttttctttctcagaggacgttgacttctgcacgaatccctccaggttctgtgaaatatttctcaaggttgtcagttgcccatttcataaccctacagctaggatttctctccctgtctcactatctctctcctccacctcaagcctcagatcaaaaatctgtattcttgggacttctcccttttgagctagaattccacatggaatcactactgttctacctgagagatctataaatattttaaagacaatattagtttctgtccttagttttttctcttcaatgttaatattataaattctgaacatgaatatatgtcaagttctctttccatctttaatgctatacgtaaatgttttaagtttcatggccaggcgcagtggctcacgcctgtaatcccagcactttgggaggccaaggcaggtggatcacaaggtcaggagtttgagatcagcctggccaagatggtgaaaccatgtctctactaaaaacacaaaaattagccgggcgtggtggcacacgcctgtagtcccagctactcgggaggctgaggcaggagaatcgctggaacccaggaggcagaggttgcagtgagccaggatcgcaccactgcactccagcctgtgtgacagagtgaaactctgtctcaaaaaaaaaaaaaaaaaaaaaaaaaaaaaggacaggcacagtagctcacgcctgtaatcctagcactttgggaggccaaggtgggtggatcacttgaggtcaggtgttccagaccagcctggccaacatcatgaaaccccgtctccactaaaaatacaaaaattagctgggcatgatggcacatgcctgtaatcccagctactcaggaggctgaggcaggaggatcacttgaatccgggaggcagaggttgcagtgagcagagattgtgccactgcactccagcctgggcgacagagccagactctgtctcaaaaaaaaaaaaaaaaaaagtttcttgtttctcgatgccgcctttaaagtgtagtgtttggagtggccgtgccagggagtgtctccacctctctttcctcacccacagatggttctggggaagctgcatcacagccgtcacttgtattgagctcacgtgcaaccaaaaccctttatagagttgggtttttagctgtgtctagacgcttttatgctgaattcttgaacacacatagactcagctggactcttttacgctgaattcatagacacagctagactcttttatgctgaattctaaattcttgaatttaagaatcttaaaattcttgaattttagacccaaaacagtgccaaatattttatctttgtcacattttctttctagtcagagctgacaggttgttaaatttaagaattttttgaatactggttcttttctattttctatttctgggtatgtccatatctgtatcaactaaaaatgtcccaagcctgccattactaccagtcccttagccattaataaagacatgcaaccagaaatgattgaggacagacctgctgggcatctcctgtccaggttgacactgattatttgatcaataattttgaaagatggattgtgtataagttacaatatatttgatattttgtaaaaaaaaaaaaaaaaagactcagtaagcccaagaatctaagaaaattaatactaaataactttcccaaatgttgacataagaaaaaattatacctgagaaaagcattattaatgtatttttaaaataatttatttaaaaaaattattgtggttttcttacataactagcaattatctataggctttgagaaaaatgagtcaaagcggaacacatactcacattactatagatgttttaattcagctgtaaacctttggaggataatgaccttgttttgccctatgtgcgtggggcagagggaggcaggaactcaggcctggaaggaacctcatgatagtgttgctttttcctttttccaacaaaaagttagagatgcatgatcaataaaataacaagcatataattgcattttgaggtaagtgagcagatgctgtgttgctagggaattgttgttgaatgagtataaaatatgaatttccagaaagttgtcatgtaggtaatatctgattttattggcaaggaaattctcagtccctgtgaagtcatcattaccaagttttgagaatttaatagggagtcaatgtatgcattggtgtgtttctttcttccttctatttcaggtactagtctcatcttttcccagaaacgaaggttggtcagaccatctgggattagaaacagacagcaaaagtgtccctttaacctgaggacactacaggaaaggtctttctttcctttgggcattttcttcatgattgctttacccctatactcatgctactgagctctctcctttccattttgtgaataaactgggactgaagataagatttggaataaatgtgtacttattatcaaaatgaatattttatctcttgctaattcgtagtaatttgcattggttagttcttgaagggaaatgatctaaaaatgtaaagatttatgaatacggaaaaacatgaactattatttcttttaatgtttccctttagtcaactttaggaatacaaaactgagttgttttacctcccttaagttttgggacatgtgattccagctctgttcctgttgatgacagaaagtcacattcaaatctcttgatatcatatctaaaaatcctgatttgtggtcaggcacggtggctcacgcctgtaatcccagcaatttgggaggccgaggtgggggatcacctgaggtcgggagttcgagaccagcctgagcaatatggagaaaccccatctctactaaaaatacaaaattagccgggtgtggtggcgcatgcctgtagtcctagctactcaggagactggggcaggagaatcgcttgaacccaggaggtggaggtaacggtgagccgagatcgccccactctactccatcctgggcaacagagcaaaactctgtctcgaaaaaaaaaaaaaatcctgatttattacagaaaggtccagagcaaaagcagcattttgaacttggtgtatggttaactggacagggatgtggatctgaaggagagcagagtatttgtactagcaaagggacagaaaggacaagttcgggtatcaaaaaaataggtgattaaaactataggaaaaaaccataagggtatgaattgccttgtaaagaaaccattttgagaaggagagcaggaagcaaaattagttaagaaggaatgtttttaagacaaagtaagtattcaacagtaaaaggaaataaaaggtttattgaatgttcccaacacaaagaaatgatgaatgtctgagttgctggatatgctaatgaccctgatctaatcatcatacattgtatgtattgaaacatcactatgtaccccataaatactcataattattatttgtcaatttaagaatattttaaaatcacacaaaacacaatagcagcattattatgtgacaatatactcccaaaatacagaactagtaagaaatattatcaatagacatggcttcaaagaaatagaaattgttttctaaaatatagactttgggcagtaaagcattgcagattgagagaaaacattctttttcccaaagagaagacaatttccaaataagatagtgtccataatgctttgtaactagtgggtgcctcttacgctatcagcaaacttagttccagttcaccctcctcaccttccacccagagactttagggcatgttgctgggggtcaaccttggaagatctctgcatttgaagcaatctactgtctccctgggatgggccgctttctcctttgagtggccgtaacccagcccagagctgctttcgcagaggcaatcaagctatggaaagccctgctcattttgtgttttcagggttgcctttgtttatctctaattcttaagggaaaatgcttctgtaggctcaatgagaccgagtggaaaccatagccaagtcctacagcttttgtagtttctgtgctggggagactacagatctatttggaaaaatagaaactgcattagatcaagctataactttaatatttatgaaaaagctctaattgttgactctctgcagctgaattctacattaaaccctgtagacagggtttataaaatatacatgtacaagttcatataataaggattatttgataatggtaaaaaattaaatgagtattcaaatataaacataaaaatatggcattttctcttctactctaatcctacagtgctatagtaattttttttccttctgaaacctttatggaaaccctaattaacgtaagtcaactgttcaacatctaatattgttgaaaaccttaagtaggaataaaattaagcatttatatttaagtacagttgatactttaaaaaattcttacataaaatctttaattatgatttgctttgtgtatactggcttctgcgatcataaaagaaattacttaactttgccatctctaaaagaaaagtccagagttggcattgtttccagcttatttttcaagacaacaaaaaagtaattttggaaaataagttattttagaaaataaaatataacattttttagaacctggagttctccaaatagtttgttctttcgagaatatgattgagctttctttgccactcaggttcaaagcactgggaagaagtgaaaacaattcaattattggatgcacatttttgaaagggccttacattgctaaattcaggagttgccataattctatgtcatgttgcaagcaagctaaacatcaagagaggtgttgtaaccagctaataattataaataatgtgtgaatactgtcttttttttctgattcctgtgagaaatcagaaggaacaattgcaaggaaatatgaaatcatgttcttcaaatccttcgactctgaaacacagataagaggactgctgacatgtagggaccaatagaatgacagctcgttgcatacaaagataaaaaagacagtgagtgactttggagttgtgttgccttctgcagccgagagaatttggacccaactgtcaaatgactattttttttagaggagtgtaaatggtgagtgtgtacggtgagctagtggtatggttcagaaggaatctgcagatgagctagtggtatggttcagaaggaatctgagcgctaataaacacccactttcccagtaagaaatgtagtgtgctgtgtattagaaagcttcatagactccagaaaaattcaaagaactaaacatgaatcctcctgtcagtaagtccaaggaaacctagactatttcatgcagaaatagcacatttataccgagtatcacttatcacttacagattatgttctcattcattgtcttgtttttaatcttcaaaacaatcttgaaaagaaaatccttgagagttgaaagaaatttaagtgacttggtaaattcatatggaagatggtaaaacattattgtcaatgtgctgcgtcttgcttaatgaatttcctcaaagttagagacagtgtctataatacttgtccttttaagctaagatcataaaatcaaccagtaagatgataaaatatgtagcaatgtatctaaatttatcaagctctgtaaaaccctaggatcaagcagtagcttggagaggtcagaaagctcctgagcttgcaccttcttaagaagaggagaggggaggggaggggaggaagggaaagaagagaggagaggagaggggaggggaagggagtggaggggacgggaggaagagagaaaagagaggagaggaaaggagaggctttagcatgaagcctctggatgctcagattctgctgggaattttggcagcgttatggaaggtccatcacaatcttgaagagaggctttcactatataccaagcatggcttagtctgaactggttcatctggacccaactctagccaactctagtgtgtctcatggtctggtgtgggccgagggcctccaggcctccagagccagccctgtccacaatttggtaatattccattgtttccttacagagctcaagattgcaaaccccaaggtgagaaatggaaaaaagtaatgggacctttaagctctgacgttctatgttcctacagcataagctggtggcttctgcgggtctctgcagccacctcagggcctttctgctcttctcaagagcaagagaagcagaacttcttctcttgcactggaaatacctgtggggtgtgtgtgtgtaagatggacattgagtgaagggacatgagcttcttgaatatcatgttttacgcaaacaaatgtttctgtttttttttttttttttttttttttttgagacggagtcttgctctgtcacccaggctggagtgcagtggcgcgatcttggctcactgtaacctccgcctcctgggttcaagcgattctcctgcctcagcctcctgagtagctgggactacaggcgtgcaccaccaaacccagctaagttttgtatttttagtagagacggggtttcaccatgttggccaggatggtctcgaactcctgacctcaggtgatccgtccaccttggcctcccaaagtgctgggattacaggcttgagccaccgctcccagcccacaaacaaatgtttagcattaagtattgtgtattaattaaaagactaagtctttttcataatagcttagagctcaatagaaaatacaagcaagaaatgatgagtacattcgtggttgcttatggctagaagagggaggagggatagagtgtgactcccaatgggtatgagatttttttttttctttcctgtcttttctttttgaaacaggatcttgctctgtcatgcaggttgaagtgtgtggtgcgaccatgactcagtgcagcctccacctattgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattacttttggcaaatatgaaaatgttctaaaattaggtaatggatgcacaactctgtgtactaaaaactcttgtttcccactttaagctagttgttgtgctttgtgatatgtaaagttcatctcaataaagctgttttaaacagaaagatgataaggacttcttttttttttctgaagcaagccagggtaaggtatttacaaattatgctgttctctttatctctgcaatgacttttaaatcttgtccattcttttcatccattatgtctgtgtcatagtttgaaccctcatccagttttggtccaatacagatggtccccgagttatgatgtttcaaagtatgattttttgaccttatgatgatgagaaggtgatacattttaagtagaaacggtacttccagtacccacacaacctttctgtttttcaccttcagtgtaatgttaaataaattacaggagatattcagcacttcatcataacataggctttgtgttacctgattttgtccagcggtaggctaatgtgagtgttctgagcatgtttaaggcaggctaggctaaggtatgatgtggtaggttagtgtatgaaatgaattttgaacttagtgatattttcaagttatgtgatggatttatcaggatgtaaccccgttgtaagtcgaagagtgtctgtagttacacagaaataataatatgtggttttggttggtttctagttgtaagttgtaaggccttttatgcagactgctgcatttgactttaacatggttttcttacccccgttctttctcaggctttcctaaagcacagttctgatcatgttatattcttactgaacacttcacatggttcaacattgtctacaggatgaaatgcaaactttttaacttgatctatgattctgtcttttttgtcttatttttcacatcatgatcttactaagccacaattcatttttggcatacaaaacatcctggcgttgacttaaagtatactccacttttccacttctctgctttttgcccttctcctaaattcaagctgtcaacatttcacccattcagctcaaatgcttcctcctacatagtcttcaatcgcacgcagcagaattacagccttgaaaattacaaacttctttgtattttaattacttgtctatgtgcttgcctttctactctgcctatctattcaaattattgttcagttgaattttcaaattaatattgtattgtaagcctctttatttgtaattatagagaaaatagattcttatagaaatgatgaagagcaaaattccatcagagccaatacggaccttcggtctacagggaagaataagtaacagatttccctcgcccagcacaagatcgatggctgagaccccaacaacagaagacagactaacaacagaaaaacatagaaacttatttaatataaattttacatgacacacgagccttcagaaatgatgcaaataaacagggagtctgtattttttggacggttgtgcaaaattggactggaggacaaagggaatggtctaatggaaatagacaggggaggctgttcacattcctcttggtgtcctcatgtcacgtgctttcctcccagatgtaggacaagccaggatgctctcccaggaggctcttcaggagagaggggagggagaaggtcagagagtcaccttcccaggtttcatggctgctgcagggagaaagggcgaggggaaggtgagcaaggccttcctgcttctgttgttttctcaaacgcccaggcaccatgttttggggtggcatgtcctgaacctggtctggcctcacctcactataggctcctgtttcttttcttttttttttttctgtttccgcctccctccctctaaacattctaatttaccccaagctctcttccccagaactctcgtgtctgacagagctcgaattctgtcaaccaggctggtcagctccagactctgactaatgaaatgcacttgttattaacttatctccttcaggagcaactctcaatccatgactgaattgtacagatggaacacaggagggtgagatgtctccttgctggaaactgcacagtgtgaaggctctcgggaattgctttatggaatcagactccttcgttccttcgtgtacacctcctagatgcatttttacagaatcagactccttcatgtacacttcctaggtgcattttcctggagctcatctggagtccaggcctcagcttctgttgtacaatgagggatgataatggcagatacttagatacttttgagaaggccacctgagacgtgattgccaaaagcaagtgaggatgactgaatgagagaacggtgaatagcagttattttaaaatttatttttaacatccctacatttattgcaactgattcttgtaggaccacaaaatgtgaaacggatttcaaaccctagcagtgcacaggaatcatcctgtaaagcctttaaaagtacagatctggccgggcgcggtggctcacgcctgtaatcccagcactttgggaggctgaggtgggcggatcatgaggtcaggagatcaagaccatcctggctaacacggtgaaaccccgtctctactaaaaatacaaaaaattagctgggcgtggtgacgggcgcctgtagttccagctactcgggaggctgaggcaggagaattgcttgaacccgggaggtggaggttgcagtgagtggagatcgcaccactgcactccagcctggcagcagagcaagactccatctcaaaggaaaaaataaaagaaaaaaaaagtacagatctttgagtgatcacttttagaaggtccagggctgtgacccgtaagctaatgttttcaaagcttctcaggtaatttagaagtaactggtccttaggttgtcacgtgggaattactgattcttccgtacatatttagtaacatctagagtattctgatccatgagaatattgtctagatttcagagcttctttctgaaatttaccgagaatgaaactctcctgaagataggctttagatctcatcctatgatagtctcacagaaaagaaggtagcttgatggagagtttatggatattctacaacagaccttaatccaggtggtattttattttattttttttaattttttgagatgacgtctcacactgttgccaggctggagtgcagtggctcgaactcggctcacggcaacctccacctcccgggttcaagccattctcctgcttcagcctcctgagtagctgggactacaggtgcctgccaccatgcctggctaatttttgtatttttagtagaggcagggtttcaccatgttagccaggatggtctcgatctcctgacctcatgattcacccacctcagcctccaaagtgctgagattacaggtgtgagccaccgtgcccagccaatccaagtggtatgtcaaatctagcctaaagagctttaaacatttttcatgcatttatttaataaatatatatatatacacacacacacacacacacatttgcatacatgtatatgtctacaaacatatatacatatacacatatacatatataaatgtgtaaatatatacatatacacacacatataaatgtgtgtatatatatttattaaataaatgcatttttcatccacttattaaagatatacacacatatacacatatttgtatatatgtatgtatatatatataaaaatctgcaattttaaaaaacagcacaactggaataaatgtagacatatagtttatagtactttgtaattgtaattaaatactttcttcagaaaattgcattaaaaatttttttatggctgagtgtggtggttcatgtctataattccggcatgctgggaggctgaggttagaggatttcttgagcccaggtgtatgagaccagcctagacaacatagtgaaacccatctctacaaaaatttataaattagcctggcatggtggtgcacacctgtaggcccagctacttggaaggctgaggtgggaggatcacttgagcccaggagatcgaggttgcagtgagctgtggtcacactactgcactccagcctgggcaacagagtgagaacttgtctcaagaaataaacaaaaattatcataatatgaaagtattgataatttaatattcttttgttttttaaatggtaggataataatgtgatttctaacttgccttaccttcgtgtccactgctttaaagacagaactaacatgaggagagaaattagaaaataataaagaaaacgaaattcataaattaaaacatgaagacattatatctgaagggctcttagattgtataagtcaatttttccctagaatatgaaattcttacctatgagaatgaatgttaatgtacttttcaaactaactttcaccttacctttagatgaccttatttcatcagaaaagaagtaaaaaccaattcttactcagaatagtttgaacttacacttaattatcatctatgctgttatttactatagatttcatttaacacagatttttaaatgattattataattggtttcatgggtgagtttattttataatgagtaagagaaagaaaatgtacccctattttatgtcaaatatttttatagtatataatatcttcaaattgtaaatgaatatagagatttaaaaatgttaatagcttctaaggctgggtgcggtggctcatgcctgtaatcccagcactttgggaggccaaggtgggtggatcacaaggtcaggagatcgagaccatcctggccaacatggtgaaaccccgtctctactaaaaatataaaaaattagctgggtttggtggcaggtacctgtagtcccatctacttgggaggctgaggcaggagaatggcgtgaacccaggaggtggaagttgcagtgagctgagatcatgccactgcaatccagcctgggtgacagagggagactccatgtcaaaaacaaaaacaaacaaacaaacaaacaaaagttaatagcttctgaatcattataatttctcaagtgagtaggaatatatttttcttcaaagctcttgcaagattttctgccaatacatgatttagaatttcataatcaatatttattgtttagaaaccctaaaagactgctttcatatttaattttttgtttctgtgattattaaattatttgcctttttaactaaaagaaaaaagacttactcctttttcttctaggtactaccaaaatgcttttctgggaagaacacaatgtacacatccaaactgtaatcagctattttctcttgtgcttgcggcttttcagagctggattatttgacgaagtacatgctgagggctccatcagagcaatagagatagagatgatagagatggagagagatagctacctctgtctaggtgcagatataaatgatgtagatgcagatataaggtgttccatgaaagggccataaatgcaaagtggtcccctcaaatgcaaggaaccgaagaaagaggcggacaaatccagtttgcccataaaggatttattctatttatttgttagagaagttaaagacagaagtgtggtcttgggcaaccacaagacagctagatctctgcactaaaatccccaagacccagaacttacatcatgcggaaaagtatgtgtgttctggaagaatgtgtaggtggctgagagaatgctgtgggcaccacagtctatgagggacacagcaacaccaaggctggttttggaggaaaggcgaaacttacagtaaataggtccttctacaaaaagggtttacatcaactaaatatcttggaggcattccggggctcgagattcatcaggaggcacgtggtggattagcatctaaaatgaagtcactctcgtccctatacagggaataatttgatgcttgatgtcactaaggcacccatcatgagtaagatcagtaatacggaactgacggcattacatttgttctacagagttattaatctagattcaaaatttggataagagacaatatcatcttttctgttcttagagcctctctgagcctaattgggcccgagttgagtgtttccatttcagaaattgtggtgtcagcatgctcaactataaaataaactggttctttatgcttttagtaagtcatacctcttgcaatttactggaaaagtagaaatgcaaagagctccttatgcaacttaatcagaagaacacaaatcagggtcttttaatgaaggtttaagctgagctttgacatgcgaattaggagacaatgcagtaatatctagtatatcttaagttttgatatttgaaagatgattgtgaaataatttttctagtttcattggcatatctactatactctaggcaaggggctggaatcaacaagcaaaaatcaacaagttttgctcttgaccatctcacagacttgtgtttctttatttttttctctatcaagccaagctctatatgaaggcaattttatgatgttgcagattttatgatgttgtgcacttactttaaagaatagcctttacaactcttgagtacactcaattatatttcttatgcccactgaagtttttaagtacctaataaaaaatagtgtatcagaagaggtggcaccgtcaggaatatttcaccagtattaggccaatgaacattagctgtcatgttttcagcattatgtggagagctctgagtcaggtgcacacctccaaaaaacctggtgtgaatatttcagtctcagcaataaaatcacacttcatgtgttacgcataaaggaagatttattaccttcatatcctcttattaatttctttctttcttacatcaggtataattccatacctcagccctttggccttaaagagtaatttaatctattagcccagaaaaccttttaagtcaatccttgacatggaaggaaggcagatatttctttaagggtctggtgtactagaaggtcagtttctgtcacagatcccaggagccgtgcagctaaaaacaaaaccctctggtgctccgtcttttcgccagtacacgcctttaaataagaaacaagacaaaagagacagatcaacgctcatccctgggcttgagcctcaggaaaatggttttaagagaagacgcctgttagcgccagacaaaaggcaattagtgctcattcgggggacatcacgtggtgagggcatgtggactcccttcatccacaagccaagtacgaagggctattgctctgttactaacagggattcatctttaattattcacatttgtatttttttccccagtaggaaaataataatgtttttcatcctttcctgcatatatttattatttttatgtaaattaagagttacactacagagtttctcatgaagaaaaggaaaatacctaaaagatagttacattacaaagaagaaaacacaaatgtagcttcctgaatttttcatgaaaactcacccagaaggcactccatatttcagaaacaaatagcatgggggccttaggacacataaacaatataactgaataaaagaaatttcagaagtcttgtagtcctacaaatatttctctttttggaaaagatttattgaagcaaataaaatgataaaattatgcatgaattgaaaaatatagtgggatggaggaatagaacatttgtgatgattcttgataaagccacacaacataaggtatagaaagtttggtcaccagccaggcctggtggctcacgcttgtaattccagcactttgggaggctgaggtgggcagatcacgagttcaggagtttgagaccagcctggccaacacagtgaaaccgcatctctactaaaaatacagatagtagctgagtgtggtgatgggcacctgtaatcccagctacttcgaaggatgaggcaggagaatcagttaaactcgggaggtggaggttgcagtgaactgagattgcgccattgcactccagcctgggcaacagagaccgtgtctccaaaaaaaaaaaaaaaaaaaaaaaagtttggtcaccatccaagtaaagaaaaaagagaactaaatctaagaaagtggcagttaagtggaaaaggagaaaggttaaaaggaagtcatcgaaaaagagaaacagaataaaactagatgttttaaaggagaaaaaatagacagtggcatcaagaattgcttttaggtttcaagttgcaattcctttaagaagtactgtctgtgaataaatattttcaaagcaaggagaaaaaattaatttagagataagggccatagaaatgataaggtttgttttggttatgctgctcatatcaaaatatttaagtaacagtaatgagcaagtaggtagagatatgagtttggaggttaagaaataggtcctgatagccaggcgtggtggtgggtgcctgtagtcccagctactcgggaggctgaggcaggagaattgcttgaacccgggaggtggaagttgtagtgagcagacattgtgccactgcactccagcctggaccaccgagcaagactctgtctccacaaaaaaagataaaaaaaaaaaaaaaggtggggggaaagaaagagagagaggtcctgagattatgaaaaagaaatgagatctattcacaaactggcagcaccaacaatagagaatgtaagatgttggttgctattgggaactaagtgaggatgatagttgttagagcacattttaaaatatataaccagcatggcagatgtatacatatgtaactaacctgcacattgtgcacgtgtaccctaaaacttaaagtataataataaaaaaaaagaaaaaaaagaaaaatttacctgccctttaaaaaaaaaattacaacactgtctgaaataacagaaaaaaaatatatatatataaactgatgcaagaacttcataaatgataatgtccattcttcttacagaaatagtggaatggtcaaaattaaaactatcatgcagaatcaagggtgagttaggttcaagaaacaagggatgtttaccctggtcagatattgaagtcgatcgaagtgaaggctgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcgtgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagtaaaaaagaataagaggctggatatacgggatgcctttgtatagagaagatttatacagattatctggggtggtgttgatacacatggtcaaatgaaaaaatggagatttcaaacctgagaaggagaaaatagattaggatataaggagaaggaggaaagtcttttagacgatgaagtcatatcgaatcaggagacacatggtagtagagctacagaaataggactggacagtagggatctggagtggattagtatgagttttcttatccacttttctccagctgtgctaaaataggctgctagcagtgaagaaacaccataatgatcacagagttggggttaattagagtacagggatcgaaagtccaacaggtaagagatttgagagcatcagtgagaagacaattaaataaacttaatatggctctcacaatctaagttaaggagaaaagtgaagccagacagaggttgataaatcagaactataaggccagttcaagggagtagacctcacagtgagaacaaagctcaagttagttgctaataaaggcacagaaaaggtggaaagtaagatctattaaaaaagaaaatcgtaaaattcaaaatcagtaatactgatcaagcgcccattgtgagcaaaagggtaagcttttattgattcagaatgactaagaattgagatatctgatgagttaagaatgttaacttacaattagtgtttcatatataatatgtatataaatatatataatattatacataatattgatgtaatcactcctatagctaattaagtacatgatattttgccaggtcaactgttatgtttattagcaacagtcacgggaatatctgaaatgttggaaatcccctatcccaattcaatattaatgaaagtaacagaaagttacatctttctgttattatatatagttacatctattcttatatctatctttctgtatcaaatatttatctccctatataggtatatttttaatctgtatctttatacataaagtattctgggtaaactgcacagaccttagcatattaaattctcttcttcggccgggcgcggtggcttacacctgtaatcctagcactttgtgggaggccaaggcaggtggatcacttgaggtcaggagttcgagaccagcctggccaacatggtgaaactctgtgctactaaaaatacaaaaattagtcaggtgtgatggtgtgtgcctgtaatcccagctactcaggaggctgaggcacaagaacccgggaggcggaggttgcaataagctgagatcaggccactgcactccagcctgggtgacagagagagactccatctcaaaataaatcaaataaaataaaatctcctctcacacactaccatcttccctaacaggtgtgctaggctctagaagtttgaaagacagaggggtgaattacttctgtattcactcagttgtataaaccatatgtcctcatccattttctactactatacagaatactacaaactggataatttataaagaaaagaaatttatttggcttatgtttctgggggctgagaagtccaagatgatggcactagtatctgcttagcatttgattaaggtgttcttactacctcacacatggcagaagagcaagagagagagagagagtgagagtaagagaacaggaggaggcagaacttcaccttattttcaggaaccaactcccatgatagcccagttctgagataacagcgtcaacacaggcatacctcagagatatttgtggtctggttccacactacctcaataaagtgaatattgcaataaagtgaattacacaaaatttttggtttcccagtacatataaaagttatgtatacactatactgtagtctattaagtattcagtatcattacattaaaaaattagatactttaaaaaaatcctgttagctttatctccagaatatcttccaatctacccacttttctttatgtctatcagtaccgtcatggtctaagccaacagcgtgctttcctcaggctatcaaagtaggcttttaactggctcctcacaggagaccaaaatgaagaaaaagaacaataacaacaacaaaaatagatactttaatttaaaaatattttattggcaaaaaatgttaacagtcatttgaaccttcagcaagtcattttcattttgctggtggaggatcttgccttgatattaacagctgctgactgatcagcatgatggttgctgaaggttaacgtggttgtagcagttcttaaaataagacaacaatgaagctaccacatcaactgattcttctttcacaaaagactgcaccgtattctatgatgctatttgatagcattttactcacagaagaacgtctttcaaaattggagtcaatcctctgaaaccctgtcactgctttatcaactaagtttatgtaattttctaatttccttgttgtcatttcaaccatgtttatagcatcttcaccaggagcagatttcatctcaagaaaccactctctttgctcatccgtaagagtagttctttatctattaaagtgttattatgagattgcagaaattcaatcacatcttcagattccagttctaattctagttctcttgctattctcactacatctgcagtgatttttctccaccgaagtcttaaactcttcaaaaccattcatgacagttggaatgaacttcttccaaactcttgttaatgttgatattttgacttcctcccatgaatcatgaatgttcttaattgtatctagaatggtaaatccttctgagattttcaatttactttgcccagatccatcagaggaatgatccatcactatctatgggagatatcgccctacaaaatgcatttcttaataggacttgaaatttaaaactactccttgatccatgcactgcagaatggatcaagaatggctgcagaatggatgttgtattagcaggcatgaaaaccacatttatctccttgtacatctccatcagagctcttgggtaactaggtacattgttgatgagcagcaatattttgaagcacttttttttttaagcagtaggtctaaatggtgggcttaaaatattcagtaaactatgctataaatagatgtgccatcttgcagggtttgttactgtattcctagagcacaggtagggtagatttaatgtactttttaagggacctaaggttttcagaatgctaaacgagcactggcttcaacttacagtcattagttgtattggctcttaacaagcgagtcaacttgtcctttgaagctttgaaaccaggcattgactgctcttgctgtgaaagttctagatggcattttcttccaatagaaggctgctttgtctccagtgaaaatctgttgtttagtgtagccaccttcattaattatcttagttagaccttctggataacttgttgcagtttctccatcgacactgctactgcactttgcacttttatgttatggagacggtgtctttccttaaactgcatgaaccatcctctgctagctttcaacctttcttcttcagcttcttcacctctctcagccttcgcagaattgaaaagagtagtgccttgtgctgaattaggatttggtttaagggaatattgtagctggtttggttttctttcacgaccactcaaactttctccatatcagcaataaggctgttttgctttcttatcatttgtgtactcattggaaaagatttccatcagaagctttttgtttacagtcacagtttagctaactgcttgacataagaggcctagctttcagcctatctcagcccttatcatgccttcctcactaagcttaatcatttctagactaaaaacacttagtcacttgaaaagttagaggccattgtaaggttattaattggtctaatttcaatattgttgtgtcttaggtagtaggaaggcctgaggagaaggacagagatggggaaatagttaaatagttgtttgatgaagccgtcagtacacatacaacacttaataagttcagtgtcttatatgagcacaattcatggtgccccagaacaattgcaatagtaacatcaaagatcactcatcacagatcaccacaacagatataaaataaaaagtctgaaatattgcaagaattagcaacatgtgacccagagacagattaagcacatgctgttggaaaagcggtactgatatatttacttaatgcaggggtgccaccactttcaatttctaaaaaatgaattatctcaaaagctcaataaagcaaaatgcaataaaacgaggtatgcacatcctaatcacatcctaaaggcctcacctcttaatactgtcgtaatggcaattatgtttccaactgataaactttggaggaggcacattcacatcgtagcaccatataaatgaatgcaaagcaaaatgggcccaagtaggttgttgaaaaactaatgggtagaagggtcttggatgctcacattaattggaggaaaatgaaaaagagacagtaggataatcaatggcaataagatttcttgccatggaaaggtctaaactagatatgaatgaaaatccagctaaatgcaaagatcaggatcggtcttttcccttttttcccaaatatacactatgttattttctactttatgtctttggtacacaaagtgaaatatggcatgggttgccaaattttgcaaagtaaataatacatagaattcagaccctactggataaatacattctatttttaatgattcagaagggccctcatgaggatgattatttttatttgtttatttacttatttattttttgtgacagagtttcgctcttttgcccaggctggagtgcagtggcacaatctcggctcactgcaacctctaccttctggtttcaagctgttctcctgcctcagcctcccgagtagctgggattacaggcgcccgccaccatgcccggctaatttttgtatttttagtagagacggggtttcaccatgttggccaggctagtttcaaactcctgacctcgtgatctacccacctcagcctcccaaagtgctgagattgcagatgcgagccaccatgcctggccatgatgatgatgatagattccttctcagcaatccagaggaattaaatctagtctatcttaatccatgtttatcaacctgtattgtgtaattcaattaggcacttaacattagaaacttataaaaacaaaagtagcataatactcagctgtgttaagaaaaatgtgatatcaactactcctcctttattacagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaatgataaggtttgatgtgctaatttcagcacctccacttcatgtctacactgtggacatatacttttttgttgttttggggtttttgtcatgtttcactcactttctctattattctttatagcaggacttgctttagagtcattactttctgttaaagttgttccttcaaaagttgacaattactggctgggcacggtggctcacgcctgtaatcccagcactttgggaggctgaggcgggtggatcacctgagattgggagttcgagaccagcctgaccaacacggagaaaccccgtctccattaaaaatacaaaattagccaggcgtggtggtgcatgcctgtaatcccagctactcgggaggctgaggcaggagaatcgcttgaacccgggaggcagaggttgcagtgagccaagatcacgccactgcactccagcctgggcaacaaagagtgaaactgtctaaaaaaaaaaagctgacaattacttttcattggcttcttcacacctaacacctatcttttcacacaaggcagaaataaattgctattagctaatctgctaaatccacttagaaatataatcaagaaaaaggaaaacatccttgtgtccaaggcattctgatttgtaaaaatggtttgtatgtgtcatttactcaaatcaactcatttcaccaaaagtactcagaaacataaccctaaacatatgtgtattccatcccaaagtttttcatgtagtcagtatttttgtatagtcacattataaaaatattttatttaatagtgttgttgatatattagtatatagtgtgagattcagatacttaaattttttgaaaacttgcattcattaacatatcaacatatattttctccttttatttacattaatctgtgatatcaacatgagagcaagaattatattgaaatttatatttttcctggaaagaaagtgaagttctgtgaacatgagtaatttgctcaccaccatctagccagtatgtctgtagaactgagatcaaaatccagttcttctaactctttctattttcaaagtagagattcctcctaatgccaaacaagagttccctggctctgttttctatcctaggaggtgattgtcttaatgattttgttttaaattgtatcttttttcagttttatgtgcagaggatataacatatacaaatataattcatggaaacactcaggttgttcagagttggaatgtcagtgattttgttgttttaagcactatgacgtgtaggagacacttacatatactaacagtatagaaaggaatgatcttaatattatattaattataattaattaacaaatttgcataaattttactaaaagtatgacatcagccaacagaatattagtagtcaagtgtgcacattggtgtcaaaataagacagtttctagcctcaaagagagtagttaggaaagcatcattatatacacaatatcatatagtatatcatatttctatagtgcttacaactacaaagcacttcccctccttttcttcctactcaaaatgatcttgtgaactaagcagggcagggcttcattctattttacagataaggcagccctagatcagaattcatggcagacattcaatcttcaaacacgtatcaagagactgctatgtgtcagcagtgatttgggggcactgggcatgggaagctaacaccagtagggtgcctcccacaggcttccagagtaagggagaagaaggaaccatcatccgtcactgggaggctgtggtgactgccataccagaggacaagggaggcagaaacagtctgaaggctcaaccgtgaacaatgtgtgtctttgaactgtgaacccagtgtgtctgtgtttgattccagtgcctttttcaggagcaattgagtcacaagccatgagattctgatgataaatgttactggaattcagagaaggaaagaacattgggatgtgctggaaccgttagagtaagtgaggttcagtgttggctttacaggatgggttagtggttggatagctacagggaaggggaagcattccaaagaagcaaattacaaagcaggagcttggcgagagacagtgggtcttgctatggtggttaattctgtgtcaacttaactgggttaagggatacacagagagcagataaagcatcgtttctgggtgagtttgctggggtgattctggaagaggatagcctttgaatcagcagatcaagtaaagatttgccctcaccaatgtgggcaggcatcatcccatccattaagggtccaaatagaccaaaaaggcagagacaggatgaattctctcttcccttcagctgggacttccatcttctgcctttggagatcagagctcttggttctcggatcttccaactccaggatgtacaccaacacatcccccacttccccacccaggctctggctcagactgggatttacatgatcagccctcctacttttggactcaggcagaattacaccacaggctttcttgggtctccagctcacagagggcagatggtgggtcttctcagcttccatgagcatgtgaacgaatgcccatgttaatgagtgtgtgcatatgtatacacacataccgatagattagatagacagatgatagatgatagacagatgatagatgatagacagatgatagatgatagacagatagatgatagatagatagatagatagatagatagatagatagatagatagattctctggagaaccttgactaatgcagttgggaatgaagtgagttgtcaaatctgacagaggtagtgtatgtagactgagaaaaattagaaaatgaagcttcaccagtagaacggcacaaaattataagtgaccattaaggctgggagagagagtttgatctttatgcagaagaaaatagggtgtggtatgcagaagggtggcatgacaatatgagtgatttagaaagcttatcgcagtgaaagatggattccagaaggaatgggtagagacagatttatcagttaaagagctgctgtaacattccaggcatgaagggtgaaagtctgagcttcagcctcagtagccagactcgagaagaaagggtaaattcaagagacactttagaagggaaaatgatgagcacagtgacagactgcctctagcgaatttcaaaatggcaagcatcaaacattactcttctctttgtactcattatgcttttcatctcattgtactttccattaattctttatgacgtgtcatttgagcaacaataatttaaacatttaagaagatgtgtgactatcattttctgagaagtacaatgagatgaaagatgttaaaagtacactgcatatagtaagtgctcaataaatgttcatgaagaaattaaaatttaaaattgctaacatataaatcctttcagagataagttttgggatctagagttgtcacacttgagttatacaaagcttgaagtcaagaacaaagaaatgggggttttaagcagtaaaatgttacaggagactgctttggaaattcaagaaaagaaattgatacaaacaactcgagagatgatatattaaaatacaaatgagaagtatcccatctaatttttataccagaggtatactattgaatcagcaaaattatgaaatttttatggattggtagtactagaatatactcaagagagctcagaaatgaaaacgtatctgtctagtgacaaaaaactaaaaatgaagttttatctctgtcaatgatttgtatatgataatgactgtattattattatgaacaaaagctgaataaaaataaagatattattaggtcacttcatgaaattaaatttttgaataacaagttaattataaatacaaatcttccaacatttttcgatccagatgattctcacaaaatttagagacaaatgtgttgtgcactgacttcacaattgaggaatggaatcaaaatcattgctcaaatgttaattataccattttgcttgttcagaaaaacatatctcagtaaaatctgatatttataagtttataaaaatattcacggaaattttttacaaagaaagaaaagccaacccagtcaatataaaaatattaattttataaataagaagtttgcctcttattcagaaaaatgtttttccccagaaaaattttacttacattaaacatcctaagcaaacagctgaaattgttttgaaacatacaaaatattgatgcgatgactgtctagtaaactagtttatttggaaattttcaatcatgtcattcatatagattctgaaattaaatacagaaaaacatctccaatgtacgtacagtttatgcactgttaggaggttttttctctgtgggaacaccatagggtacccttacccaaacctagatggtatagcctactacacatctgggctgtatggcatagcctactgcttaggcaatgagcctgtacagaatgtcactgacagcaggttactgtgctgaatactgcaggcaatttaacacagtgtaaatatttgtgtatctaaacatatctattataattttatgaaacctctattacatatgaggttcatcactgaaacattgttatgggaaacatggctgtatattcccctgaaatcattaattttcatcatttatatgctcagcatcatttatatgctcatttatatgattttatagagttgttcagatttagttcatgaatgctttcttcggttgcatcctacctaaacctttacagagattcatagctggaattaatctgatttttttccatagtacatgtttatctcctttacagcacttatataacaatgctgctatagatcagccttccctggcatgtgtgaggaattcattcagtatttgttcaataagcaatacattgaactttgaacacctcttctttcttctctggtaccctggatacggaaggtgctcagaaaattgattctaatctcttcatatttttgcagccctcagcaatgttaaataacgtgtttaaaatgagatacataatttagggttaaacttcttttttacacatattagaagtattttaaaaactaaaagagattcaaaccgcaatcaaatttgcctttgttttactaaatgagaaatgctaatattaggtttatgataaaaatattttatcaggaacaacagtaagtaaataatttttttaaaattttgacatcacttgtcctaatgttatatcagaaatcttatctaatctgttttttacctgccattgttctctgagaggaatacttgacataatgaactcaaaatacgactccatgtttatttttgtgtccttcctcagttttacttcagtgctcaagttgtttgtctctattttaaaacattttctttaaataaaaatgcgtgtacaaatcaaggttgaagctagatgcatctttcagtgatcattgactttatctgtgtctttatcaagaataaagagctagctaatgtcagaaccagggtttaatttgttggccggggcaggggtgggggaggctctgttttttcctattaaaaaatccaacactgaagtatcctcctgaatacgtacattgatatattgtgtataaagagaaaaatgaacatgtaatttgtctcctttaaaaattgacttttttagtataatgacacacacaaagtgcaataaggcaattctcccgaatgcattttctttgggcagacagatgtaagatgacttcaggagcctcaataattcatgcagcttcctatattgtcttttacattcataacactttaatctattgttccattgtcttgcttggccaatatagagaagtgatgactgaattcggtttgaagtctcagtcttttctcaccctggttttcttgtttctattctcccacaccaataaatacgtgaaacctaataaggataaaaaaattctgttgagagtagaacgatattttaaaaacacgaggtgtgacttctagagataggtaagtttagacacatgcgtgctgcatgccaatggacttgttatgctcttttttctcttcaattaatcagtactagaattataccagagacacatcttatagccagtttagtgacattgcttgacaacgctcacatacttactgaacgaagtttataatttttcatcctcatagcaccttctatccttattacaactaagtatgtcagaattgccttattatatatcacacacgaaaaactaattctaagagaagttccatcatttactcaaggtggcaggattactgtcttaatcgaaatttaaactgaagttttctgattaaaatcatgtgataatagcattactctctgggaactcacctgtcagaggtaacaacattttgtagctttcctaaagattttttctcaaggagaaaaatttagggttctagatgaataagaggttacatcttaataaccttcaacacatatcacctgtctctaaaaataagcctgtaattgtcagactcctgttgattaatttcctttgctgggaagacttgatcccattttcattgcttccctgctagcaaagccctgttcctgtcaaatcatgtgtattacagtgcttttgatttcctctacaattagtctagttttttaatgatagcggtatgtgcccatgataaaactgtagtctgcaaaataggaaatggtgttaagaacaacataagaagacttttgtttcccctataattagagcggtccaaaatggaataggctttctcctaaaagaaatatttataggtgtgctgaagctggtattgtatgacggcaggtcagaatggcaagaagaaaaatcctgcatcgactgaggggtggatctagattagtcttttctagcactttcctcgtaagaatcatctagggagtttgttaaaatacattttcccttggttctggctatctgtgtgtcagctagatcccgaggtcatttttacgatctggaagttttgacaatattgcctcggcagatgactaacagaacttccgcctcagcaaaagtctttgcactggggctaggaatgtgtcaagtgagagcttttgtgttttgcgttttttaaattagtattatttttattgacaaatcataattttatatgtttatggggtacaatgtgatattttgatatataacaatgtgaaatgattaaattgagctaattaacatatccatcatctcgtttaccgatcattttttatggcgagacgtttgaaatgtactcttttagtcatcttgaaatatacagtatagtactgactagagttgttctgtcgtgcagcagggggagggagggagggcatgggaagttgttgaatgaggggtacaaagtgatagctttaagttgtgattaagctgtggttcctagctcgagggttgaaaacagttgatggactgcaaagaatataaggcataaaaaaaaacgcaagaagatatagaaaaagaaaggaaaggattgaaggggtgggagaaggaagaaagaaatgaatgtaaggagaagaaaacatgaagaaaggaagagagagcgagaaaaaaaggaaggagggaaggaaaagctgagctcagatggaagaggggtatttaatgctcgttgaatgcatgtgccaaatttcagggataaattgggcagagtagaaaataaattaaatatgactcaaatccatagtaaaatataaactggatcccaggccaatttttttttcttttcatctactgtcagaaaagtaaagtttttgtagtagggaaataaggaacatttgatttttataaatctcctaaaacattaagaaatttttgagtttgaggtgaactaggaaaccaaatatcaaatatctgtctcttttgtaattatttcttgcctggctctcaacctactgtcttctcttttttaattaaaggcttcctgggatacatatgtactcatatttggtcatgatatcttttgatacaattataattcaaataatttaaattatcaaagaataatttccatttgtagagatgctgaacagactctaaggatgaccgtatgttccaaggcagacatgatccacacccaaaagcgtaaatagcttatatgagcagctcttagaatgacagccatatgcaataatcagctggacacctgtctctttgtgtttgcatacagcaaaatatacttagggagcatttctacatcacaaaaggaagttttattcagctttattatcaatgaataatatatcagaatacagtttgcatagtgccactcataccaaaattacagtgaattttcctcttgagatgactcagtctcaataagagatcatttgtctatatacatataacctgcacagaatgcaatttttgtgcataaatattaaatcattatgattcattttgtttaaggaactaaaaatacagttaaatctattattgtgcctaactataagagttttctgactatgcattacaatgtttgaatcaatataattttattatatgtatgttgttatacagtttaaaagtatgttagcttagagtatttaatatgtggcactcacagacaaataacaaaacgaagtccctagaaaatagcatgatattaaatgttttatcatgaataaaaaaatatttgaatagtgcttcatagaataattacctttctctgggtttataatattggtaaagtctaaagatcttctgattggaaaggaagataataatggtgtcttaagataacctcttgaatcttctcagaatcactcagaatgagacagaaatgctagagggttcacaacgagcatgctgttttgtcagtccccctcttcatccttaccatggtacagcagaaagttgctaaggatttctctcggtgaaatctgagctttgaccacattttgaagtcactccatatatacctttggaagaaatgccaaagacaatcttttgcaaaatttcttgtatttatttgtaactgaaaaatgattgagcagctattttgtgccaggatgtgggcaaggtattgagaaaaaagaaatgattatggcattaattatttttctccagcagttcacaatattctacaaaaaagagatactggggcaaaaccagaaacaaaactaaacatcagtaactaaatttttccacactaaagacacaaatgaggtaatatatacattaagacttaaaatttaaatacatccaagcccctcaagctttttcccacccagattatgccctctgcaaatcactctacagctgctgggatttgtttacagtggagctgggcacctagaactgttgtgaacatcaggtctggcatgtgtggcatagggtcagggccgtgcatgttcccttaggcttcgcatgctggtcaggatgtgcacatacttggccaagcctgtgcccagggcagcagtgtcctttgccctctgtgaagggctgactggcccggatttgttcagttcagcctgtttggtgagaaatctctcatggaccttttctcactggataaccacaaagagatgaatttagattatattctctaaatataatctacattataaaggagggaactggaaaaaggatgctggagttgaatttgccttccatctttttctacggtttccttgtgtcaaaaccatttctgtcctcatattgccctttcaaatgctaattacatttaaagtttttttcacagagcactttacagtttacaaaagtaattcaatgtgatttcatggaataggaaaataacatgttggtgtgaatatctgaggctttattctcactaagtacagggtacagatacagtaagtgaagctggtgaatatttgagagccgtgggtggtggtccgcacctgtggtcccagctacatggtcactaagtacagggtacagatacagtaagtgaagctggtgaatattcgagagccatgggtggtggtcggcacctgtggtcccagctacatgggagaccgaggagggaggattggctgagtgcaggcctggaaggcaatgtgctaggatcatggcgctgcactccagcttggcaacacagtgagatcccgcctctaaaacaacttaaattttttaaacaatgaatattttatcatagtaacagtagcaaattttaaagcatttattattgaccaggtatagtggtatagtgataagtaggtacatatattgttttatttagtgtttaaccctcaggaataagtatgcttattgcccttcacaggtgggaaaagcaaggcaaagagaaagtgaacaacaatgaaactaggaacgtaacccaagcgctcgtgccagagcgtgtatgctcgatcttgggaccacaccacttcccttggtaaattttcaagcatttagtatttgtgtgaaggcaatcatattgtgcagaggaatgaccaggctacaaaacacagtgtgtgggagaccgcttaatgctaacactaattctatgggtgacattcagatctataaaagattaagtgaatagagctgacttattgagaggggtttgttgtagtcgacttaaaaccaataaaagacaacatgatgtcttaaagtcacttcaagataaattaatcaacttataagcacatatagccattaagatcaattcactttacaaagattagaaaatgataaaggggcataaaatacaaacttactatctgagaaaatcaggttgtagggcttttctcctgcaaaatgaagtaattgtcagcaatgtccacttggtagaacagtgttttccactgttctcttcatagctttttctaatacgatagttaaaagaggaactagctcttcagacccaggcagttgaaaaccagctcattgggttccagctccacgggtccttctctacatgtttattgcacataataatgttcctcttggggaaaatatgctgcaatatccctctgatttattgtatttctacatattgttaatgtaaggactctggtattcaacaaagaaattatggcacatctgggtacacagaatattctaccttccacagaaaaggtcaggagagaaagaaaagagagaactgaaatataaacccttcaaattgaggtgaaatcctgactttgccccttggttggcatcatcattaatcactactaagcaactgcaattagaagagattaactggaacttagagttgctaaacaaaaagaaaaaaatagaaaggaaataaagctgtcttcctacgatagacaaaatcacagggccattttcttccattgatttttgctctcattaagatatattcatttactttccttttgaagcttgacgtaagaatcttgaaactagaattgtcttcaatgaattattttgcccattactcttcttatacagaggtgaattccagattggcttgggacaatgactgtttatgctttaaccatctccaaacgcaaataactagcaaaactctttatctcattctagtattaggcactccaagttctgcagcaaatattcactctgatgaccatatggaaaataacacataatttctgctttcttgtatcttaaaatcagaagatgaagccaaaacacaagataaataggaaatccaaacagtgaccccaaaattgtgttttgtgaaagaagaatagaaacacaaaagtggagagagagacctcattaggatgtgagtagcaaagggggttcagtgaagcagcagagcttccgttatgtttataagagggataacatttagagataaatcttaagatagagaaaaaagaagctgatgcaccaagaaagagaagaggagagcattagcatagtggtgcaggggctggaaccagcaccatgtgtttgtggaaacaaggaagacaggattatcagtcagcttctggaaggtatgttggaaagggtttcacaaatgtaaaagaggttattgataaatgggaagtatatacaccatatatttaaatacaatgtatttttattaagcagtgacctctttaaatgtaaagaatgtgtgctttctgacaaaggttgaatatccagcatcataaggaacttaaatttacaagaaacaaaacccataaaaaagtaggctaaggacatgaacagacacttttcaaaagaagacacacatgcaaccaacaatcccacaaaaaaaaggtcaacatcactgatcattacagaaatgcaactcaaaaccacaatgagacactacctcacaccagtcagaatggctattactaaaaagttaaaaaataacagagctggcaagattgtagagaaaaaagaatgtttatacactgggagtgagagtgtaaattagttcagccattgtagaagacagtgtggtgattcctcaaagacctaaatacagtaataccatttgacccagcaatcccattactggggatatatacgaaggaagataaatcattctattatagagacacatgcatatgtatgttcattgcagcactgttcacaaccgcaaagacatggaatcaacctaaatgctcatcaatggtagactggataaacaaactgtggtacatacacaccatggaatactatgcagtcatagaaaaagatcccgtgctttgtaggaatatggatggagctgcagaccattatccttaacaaactaacacaagaacagaaaaccaaacaccgcatgtactcacttataagtgggagctaatgatgagaacacatggacacacagaggggagcaacacacactggggccttttggagggtggagggtcggaggagggagaggatcaagaacaactactaatgagtactaggcttaaaacttgggtgatgaagtaatctgtacaccaaacccccacaaaacaagtttacctatgtaacaaacctgcgcttttactaaacttaaaaaaagaataaccacatgtgcccttaaaaaggaatgcacgccttatgcttagaattttagtaaaaaatggttaaacaggtggttttacatgcacacacattttgacagctaaatgagactaaaaggttgagtcctatggcagccagaaaacaactgtaattttatcttgcaacaataggaaaaaagttcatcttaaagtccacctgggatatcactattttgttttacaggcagttagacatgataataatcattcatctacaatatttactggtcatctactatagccaaggtacacaatttttgtaattcagaagcttagacaggtcctgataaaagactttcatacagacatatgtttatgacatatacctatggcatacatttataacatggtgtgtccggaattggtttcttccagtgggttcttggtctcactcacttcaagaatgaagccatggaccctcgaggtgagtgttaacagttgttaaagatggtgcgtccggagtttgttccttcagatgtgtccagagtttcttccttctggtgggtttgtgatctcgcttgacttcaggagtgaagccacagaacttcctggggagtgttacagcttttgtctggagttgtttgttcctcccaacgggttcgtggtcttgctgacttcaggaatgaagccacagaccttcacaatgagtgttatagctcataaaggtagtgcagacccaaagagcaagcagcaccaagatttattgtgaagagccaaagaagaaagcctccacagcatggaaagggacaccagcgggttggctgggtggccagcttttattcccttatttggcactgcccacgtcctgctgattggtccattttacagagtgctgattggtccattttacagagtgctgattggtccatttttacagagtgctgattggtgcatttacaaacctttagctagacacagagtgctgactggtgcgtttacaatcctttagctagacagaaaatttctccaagtccccacctgacccagaagcccagccagcttcacctctcaatagttataacagttaataagagcaatgttgaagatatgcataggtagaaaaagggggttcagtgaatttaatctgtattagggattgttaatgatgaagtatagtaattatatttagccaaatggaagagggataggtattctgcatagaaggcacaacatcaagctataggggcaaaaaactagtatttatgaagctacaaagagtttggtattgttggacataaagtagatgggaggaagaatgagactgacctatagaaaacataaagcagatgatggaaacctttatacaccagttaagggtttgcttcttgttgtctatgggtagccattgagaggtctaaaaaggggagaatcatgataatcgtagttggagagagataaccctgatggctggtaagaatgtagagagggaggctatttggaagttaagtaagaaggatggtcactcctaaggccaagatctccagcctcactggtctccttgttgttcctccaaccacacacccaccctgacttggtcctcctctttctgggacactcttctcccatttattcatggctagctcatacattctttaagtctttactcagttatgacttcatcagtgaggcctacactgacaagcccatttaaagcttgggatttttttttgttttttgctttttgttgtttgttttgagacaggatttctccccttcacccaggctgaagtgtagtggtgtgatcaaggcttatgccagtttcaaacttctgagcacaagtgattctcctgtcttagcctcccaattgcctggggctacaggtgcccaccatcatgcccagactccatttaaagttttaatctcctctacattcctaatcctccttatcctgttccatttatcttactctatcctgggtaccagcttctgatagccaatgtattataatcattgtttattttctgtcttccccaactagaattaagcttgagaaaggcaggattttgctttgttttcttggccaaatcaaactcaaaactcagctttaggagtgctagcacatattaggcattcggtaaacatgaacttaataaatgaagaagattaagatggaaggtccagttttttttttttgttttttttgtttttttgttttttttttgagatggagtcttgctctgtcacccaggctggagtgcagtggcacgatctcggctcactgcaagctccacctcccggggttcatgccattctcctgcctcagcctcccgagtagctgggactacaggcgcccaccaccatgcctggctaatttttgtatttttagtagagatggggtttcaccttgttagccaggatggtcttgatctcctgacctcgtgatctgcccgcctcggcctcccaaagtgctgggattacaggcgtgagccactgcacccagtcaatggaaggtccaatttaagaaacattgagactggtgaattattggatatggaggctaagagaaagagccaagaattgctccattttccagcatgggtgactagtgggttattatttccctaatggacaaagagaagctggagaaggagttgatgtagaaagaaggtgctgaattctgttttgaatatgtggagcttgtcatgcctgtgggatgtgctggcagatcccacagatttgtcccacagagatgtccctttaaagctcagagaagcagctaggatagaaaagaaaaatttggagtcatcagttcccaagtgatgtgaagaccctaaagtggaggggaggccagggagagtggtgcccgagatgacagtgtactaaggacaggattttaatgaatatcatgaataatgatagatgtatagtaccatgacctgtcaatagttaagtacatcttcctataagatgatttgggaagctaacttgtggtgatgacgtgacctgggacaatcccaagaggcaagggggttggttgaattatcacagtcctcacagctgctcaagcttctgtttgtgtgtcgccaattatgctgaaggatctagaaagatgtgccctccctgctcctcctcaggcttagcatgcactcagtggtttctgcagcaaagttgcaaactttaatgctctgtatttgtcggcagaaataagacccaaattcctaaacgcatttctaattaaactatttgattctcagctaattgatattcaattagcagatatccctaaaatgactaggacactggggccatgtagcgatgttctggaatgtgactttgaaagctgcgttgactttagaactggctacattcattttggctgaagaggtcacctagagtataggattaaaaggaaagtgtatttttaaaaatattatgcgatatttaaaaaataacatactttaggttcaatattattttatgactcacacatgccatatttgtgtgaaaatcaagaggcattctgaaatcattcgattctttttttctgcctgaattttttactttaaaaagattattatgacattccattagtggttttgacagagtgatattggattctcaaaatgaaagatgtgtgtgaaatatcagacttgtcttatttttgaaataaagacagtggcccctctcacctggaagagtgctgtctcaaacgattagatcctggcagacaacagagaacaaacatattttgattaaattatttttctattcaacctggtgcagtgcgtaacctctatgtctatggctctttgtttgatcttttcatggaggtgagtgattttatttacaaaatagaggccaagagaggaagttaaaatatagaatgatttgtgtactcatggatatgcaaaggaaggtttgaattagtcagaactacatttagagctaataagctactaatgtctaatgtctgcctttgagaatctgttttttgtttttgtttttgtttttttgtttgttggttttttttttttttgagatggagtctcctctgttgcccaggctggagtgcaatggccccatctcagctcactgcaacctctgcctcctgggttcaagcaattctcctgcctcagcctcccgagtagctgggactacaggtgtgcgccaccaggcccagctcattttttatttttagtagagatggggtttcaccatgttggccagcatggtcttgatctctttacccctgattcacccaccgtggcctcccaaagggcaggtattacaggcgtgagccaccgtgcccagctgagaacctgtttttaagggtaaacaatagtggatggtttataatgaagggatccagggtaagaagctatcccgagagagttgagcatccccaaactaggggactgagtttcaggatcctgagctcccagcagcagaaagttgtcatgttggtgacacatggatatgaatggcctgtgcagctgaaaaaggttgagaaggcagttggctaaaatttaaattgtcatccatgtaagtaaaatgatttgtgcagtgatgatcatacctggaaaaagcagtgctgggaaaaatagagccaagaaaaatgcgagcagaaaggcataaggcaagagactcgtcgggcacccagaccagctactcacagtggtttattctcttgaggagtcagaatggggcctggactcaatatgacgttttcacagggcattgagggaactgcaactgcaatgtgggttacttgctcgccgcatgcgcagcccaactaacaagagcgaagtttgggtacgaagcaagtgagcttattccgaagcctgcctgaggaaggggcacagcgtcctgcctttaaatatgccacttcacctttggagcagaaagtggtacttttataaggtagtggaggaagtgagcaagagcagggtcccccttgctagcttggtgccttacgtaccaggcaattgagttggtgccttcctgggcagaaataagttgtcaaagtggccaagtggacttgcttttcacatgccctcttggtggatgaaagttccgaggctgcgggggccgtgctttggtctgcaaattaatagactgtcaactctccaggagagatccctcttggagcacagagttaaacttgctctgcaggaaatgtctgcggggggtggccgtgaaaggttgtgtttacatttccaaagggctaagaaacagggaaaaggtggaaaggagaaaaaaagagaaaataatgtttaaaaactatctcttagaaaaatgtgggtacccggttacagaaccgcctgtggggccatgcatggggattatgaagacggggttgccacttactttctttgctaagaacttcctgtcatcttcccatcagcagcgagagcactgggaaaacttcttaccacctcactgcccgagagcctcacctcatccaaacatcaacaaatccagcctcatttttcagaagggccaccttagtctttccatgatcacaagtgaaataattaaatgactaaaagttgtacttgtacaggtcacagccagataatccttcatttgcagttaactaaacagcatgctacacaattggatgtaaggaatgaaggtgacatagcaattttccatctgtattatctgagaccatgttattggaaaacggatggtcctaaaagtagaaatgaaaagttcacaagggcaatgatgggaagttgttttaatgggatcctaaggtctgcttctactaagcaggaaacagagagtgaagcagttactattttcttgctcaacaagtgaaagcaaaaagagaaatccacgttacagagaagactgaaacagaatcccataaaaatgtttctcagtatcatttctcagaccaaccaaattgttgtgtttcttaaactgagaagttgaaataccagagagaggtcagaattctgctgagatgtattagaatggttgaggtttggcctattggagttgcagagattcttctgcttaagacctcttatgaatgtttgtagataataacagtccctcgccagaggcttagcttgtcacctctgcctaccatcaacagatgctttcctgatcacactgttttttttagccttagccactttgctctctcaagcagtggctttcaaggtttttgaccacaatcttctgaaagagacataactacatcttgaaatgtaagtgcagaaatgtatactttcagtaaaagagtcacaagacaatactactttggcagatactttaatatttccttttgtctattctattctattctattctattctattctattctattctattctattctattctattctattctattctattctattcttctattctattctattctaatgctgatcccaacttaccaatgtttgttcatgggcaacttacaggctgtatgtaatctgcagtatgaaccacactgctttaagctttttttaaaaaaaaattgaagcagaatttacttataagcttatttcttagaaatgaaaccaaaaaattaaaatattttatagaaattaaataaaataagaatatagagcagcgatagtttctggtgaatcttaactaaatattaagctacagcttaatgttcaacttatcaaccatctgagggataaatagggtcagtccagattaaaaatttctattacactgtataatttcggtctgtgtttacttgttggtgtatttatatacagaattaatatttctaatacaaattttcttactaattataattttactttaggagacaagatatatttttaaataaacaaattcactctacataaatataaccagagatttattttcaaagaagttaattctggaaggcattatgacttttatctttaatcatggaaacaaacttttgtggaacacctgtatttgagacataggaaaagacttcctgataatttttaaaaatccatttcagtttttaacacctacgtattttttcctatgtgcaaaatatctgaggaagaaatcaaaatagttaaataatccagaaattacattcagtcaataatgtcaacttaagacaaactgtgatttgggttgtattttataagtttgtttttccttttaactgaatgtatacgatgatttggtcaagttgcttggatttgatttatgctgaaataacactcagaatcaaaacaaagcttggtccaaattccagaaagtagggtaattccctaagtgtaacctgattgaaaatatatgaaaatttactctcatgtacaaaataaccattatggtttaggagaaatagaaattataagctaatgaagatagagacttggcaatttactaaaggatccaagagtatttatagcttattttttaaactgattaaaaatgtgtcaaaatattacattctaaataaaagttttgattaaattatttcattcactagctttgaggcatggttaaagtgaaatagagttcaaagaaagggaagaagtaaattgctaaaagagtaaaaccaattttgatgaattaagtcatagttaaaagagaaaaagaaagacaggtgaaaataagattaggctagaatagaagaaaaaaatgagaaaaagtctaacctcagtaagtaactagaaagtaagacttgagattaaataattccataggtatgtcatagttcaattgtacatttcatgaaattctaattctaatttgatgaaagataattccaggaaatttgcatgctattattaaatcactttaagatttttctccaaatgtgttatattagatatacatatatgatatatgtcaatttatatatatataaatatagctctctcctctttgagatatatacgattttagtaggtttctgaggtcactagttgtctccattttctctgcacttaaaatgatgcacagagtttagaagagaagattgggtgagagctctgcatctctaaaaacagctgcccttgcccggatcatgctccgcaaatgttctgacctaaggctcgaatcagatgcataggttatattgactcaagtcgaatatctatttttgggtttaagtgcatatgtattttcaatggcaaattaaagtttataaaatggaatatgataaaagataaatgcaaaaccaaagagaaattgataccttgatattttcagtgaactttatcaaaattcaaaattgaatatatatatttatttaattatatataatatgtatatatatgaatatatagagatatagatatccatatacataatatattatataaaatatataaatatatatatatatataaatgctacataaatatacgacctcagacttctaaagctgaatataacaatggaattaaaagttaaaaattagatcttctgggcatcttagaattttgaaatctttgaatataggaaatttagcaagaactttaaaatgcttaaatggttttaccattgtattctgctggattttattttatggtaatcaaagttgtcagaaggtcagagactcataaatagagaacagagcatcaaaaagctcattgacaagcctaatgcacatgctgtctcttctttaaaaaatgaataaagatgacaagaaacattttgctcttcttttgtaagacgcagaataaactgtcatcttttctcttatgaatagaaaatgcatgacataaaataggaaacaaaaaatatagaaacgtagaaaatgtgtcataaaatagaaaacagaaaatgtgccatctcatgtactaaatttatctgatgacatcgcaaaagaaataacctagtcactgagtttaacattttgatgtcttatgtaatcataaccattgacatgaactttatatgtgttttctgtctatcaaagttcatggtcatgaaaaaaaacgtaaactatttttactaacatttttaaagtgaagaagaaagccttattgtataatttatagtggattctaacttcattgccaagaataatacattatagtttcttagtcattttcattatttgtaagagtgttaaacaactcctaatcattttacttatttttaaagttaataaagcaatatatgtaatatgtaaaaacattttccatgtaaagttaaatttagaaagtgtaaaaattggtgtgtcactgttcacccttattccgcccttgctccctcaagttctgatttcccagtaggaattccataaaatagaatagcttattagaattgtagttgatatgcaattaggtaaaatgttaatttgagcacaacacatctttataatcttgaaccttcctctattactatagttttattattatttattagtatgttttttcatttattcagatattatttctgtctctcaatgtggttttataattttcttgatataaattccaagaacctaaaatcattgctttatcaccttttgatgcttttggacttgtcacccaggtgaaattcattttgaactacagataaagagatacttgttatcaataattgtgactgtctgagagttcactctctttacaagctagctgtttagcctgttccattttcatgactgtttcaagacagcaggaggttctgggtcagagacaaagaatagtttattactggaagcaatagccagtcacttgactctgggtcccagaagcctaaacacagggcattgtgaagagagccaggtgacacttgcctgccaagtagactgtggtacagcacaaacgaagctgtgggaatctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctggaagaggtttttcagaataaagtgcagttatggtctcacaagatgttaagaaatgtgaattgaagtaaaagttctgtgatatattaagctatgatatactaaaacttttagtttgcatttttcatctgtgaaaagtctattgaatctttttcctgtgtataaatagattgttttctatgtaaaagtgaatttttggtttcggtcattgctaaatacctagtgcctgttgtagtgtctacacatagtagacactcaaataataaataatatttgttggataaatacatgaactaaacaagtaattcatgtttttttcttggttcctaattttttcccatatatatgtaaaatatatatgtataccgtatatatatatacggtatatatatgtgaaatatatatatatggtatatatatgtgcatatatatatatggtaaaaaagaatttcctttgaattatctataaattgggtggaggggaggtgcttttcaggagggccacagtgcgaggtatctttcatgccttccttataaacacatacacatacgaatatttaaaaagtataatcaggacaatcaaaactggcatgaggtattataacatcattgtaacacctgtggaaggaaagtaaatcttagggcccctgaaccactaagctaaaggcaaagtcaagctgggccaacctgcctcccattctgttcaaagtcagcccccctgctcactacatcaatgcatacttgactgccctctttggggaggcgcatcagaaactcagaagaacgcagccatttgtctcttatccacctatgacccagaagcctcctccccacttggagtcctcccacctttgcttctagttgtcctgcccttccagaccaaaccagtgctcatcttatacatgttaactgatgtctcagatctccctaaaatgtataaacaaaatgtgctctgaccccctcgggcctttctctctgttaatgggcttgtcctgaacattggcaaaataaactttctaaattcactgagacctgcctcagatattcaggattcacacaccttaatttcatagacagtaattaatgaataaaatgatctttgtcaaacacaaaaaaatgtatgttctcattttcttaccagaagttttagatttttactttgagggtaattttaaaacaccaggtcatgtgattcatggtctaacctcccatgccagtttggtagtctatgacacaatttcactcaactacttttcactccttgagtgttacacgtgttctccccgtcccctctctgtcttgtcttggatcagtttccaaacctctgcacctaagggctcatatctttatgtaatttgttcctcaaaaaaatattacatgttaattcttctaggaaatcttccttgaatacccatcaaaatgagtcaagggtccttacagtgagctcacctaccaatctatataattggtaatcacagaactcatactaccaaaattattgatatgtttgtttaaatcctttctggagtatgtatcacttggtatctttagcatttatttcaatgcttagagcatcagaaatggtcaatatggaagaaataaataacctcctgagtgcttggtaatagcagcaatatgcgttaacatttgagagcccctgtgtgcttattcattgtgacgcctctcactccgagaacttgtacttggattggccattgggagtttataattttttttttcataagagtctgatgctttaaaagcagctaccatttacttaccactattggaataattttaagtgtaaaattccatgaaagctgaaaactgagtaaaagagttgttcccctcaaacgggactgaagattagggaggtagacctgtacaagaaaaaaagacaaggaagtgggtgagaagtagagtaagggtagagaaatttgttgaaagtttcatttatataataatataaaacatctgtatgatgccattagaataagctgtaaattctgttaaaaaaagacaactggccaggcacggtggctcacgcctgtaatcccagcactttgggaggccgagggaggtggatcacgaggtcaggagatcgagaccatcctggctaacacggtgaaaccccgtctctactaaaaatacaaaaaattagccggggtggtggcaggtgcctgtagtcccagctactcgggaggctgagggaggagaatggcaggaacccgggaggcggagcttgcagtgagccgggatcgcaccaccgcactccagcctgggcgacagagcgagactccgtctcaaaaaaaaaaaaaaaaaaaaaaaagacgactaacatgaaaattttaacatgattgaaattttttttttttcgtttttactttaaggtcatggattttcttctgactctggacctgctgagaagagttctgtgttattttatggcacaaatcatagctaatgtattatccaaaatattgtttaatgagaactaaaaacataggaatttgggtgaagaacaaatttcttcacactttttatgattccttatcgacacctcctacccactaattcttcaatctggccaacaaaaatttgatcacagatatgtttgcttcacctttaaagtctttacaaagcacttaatctagtcttaaatacaactgttcacatgcatttcgcatcaatttatatagtacttagttataacattacaataataaatacactgcaaatcaggtttggtaacacatccacttatattaacaatgccctgatgcacgttcaataattttgtcttttcaccctcaacaggtaaagaggagagagagggagagagaaagaaacactaaatgtgttttataagcaaaatcagctgttacatcatgatgattgttcaaacagctttcttcgctgatacaattgcaaaaagattataatgtccagtcaattgcattggcctaatctagagtataagggttttgcttctgggaatttgtgtttatatataaagtaggttttttaagttagtatatattgaaaataattagtggcttaccataatactttctctaacaatcttctgatacacaatatctcttttttctatattaagcttattaaatttgttccctaggtacttaaaatatgtcttatattccatatagcaaacctacaagatggatatgaatatccttattctgcagattagaaaaatgaggacaatgttgtcaagtgactgaagtggacccataggtagctgtttcccaatactattttgaatctcagttgtatgctctgcattttcggctcaacactaccacctcctgaaaagacttttaagcagaatttagaggaaaacaaatcaaacacatcagaaaacatcaaagcaaatgcattaaataagattatactgaaataagttggacacactgtggagatttccacttctgcccatgaagaattaacagctacagaaattgctttctgagagtaaatgactagaaacctggaaaaaaagatatgaagcaacagttttaggtgacaaacagcacaagactaaaacacctgatgggggaagaaaacaaatgagataagatttatgtctggaggaattttctatagcaaagtgaagggaacctgaactaaagcccagcagtggattgaacagcttcaggatttcaggaggctgaggtaaccacagcagtggattgaacagcttcaggatttcaggaggctgaggtatccagaagttgaaaggtaaagtactttggtagaataagatacataccgggagaactttcaagatcttcagaagagactcttccagttttgcttgtttgttttgttttgttgcaaaatagagatgagaggaaattccatgagactggggaaagaaagcagtaggcaaaataattctacggcaactgcattaggaatacttcatgtcctatctgccagaatgtagggacttcttaatatatggggttagtgtagaatccagaaaggacacatcccttagtagaagggttaaattagttaattgtgctaaactagcacaagaatacagatgttctagacccaacctaacaaagctcaataggataaagtaggataaaactaacccataaggttcttacctgtgtgactaaacaaaatccaaaactctttaaaaaatgtaaaaaaaaatagcacaaataacataaaattcacaatgtctaccacccagtaaaaaattaccaggcatgcaaactaacaacatttggctcataaccgggagaaaaataaacccacagaaacatatgcagaaataacaaagatgatcaaattagtaaaaaaggatttcaaaagattattataaatcttatggttatgctcagtgaagtaaatgaagataaacataatatggagaaaataaaagatataaaaagactggaatggaacttcgagaaataaaaaacatgtcaaaaaggacaattacattcgattatagaaaaagcatctaaaagattagcaaacttgaaagcctaccaatcaaaattattcaaaatgaagcacagaatgcaaagaaaaccaggttgaacagaaaagaacaatctttcattcagttttaagacaatatttagtggtctaacacatttgcaattggagttctaatagataatttcaagggagaaaaatatttaaaaatgtatacccccaattttgcaaatttatttgtttaaataaaaacaaattgagcacataaacacaaaatatctgaaaaccaataatatagataattttaaaataaaccaggaaaaaaacacattatatacagagaaataaaaataaatgtggcagaaaattattactagagatcacatcaaccagaagtaaattgcatggcctctttaatgtgctagaaaatgttagctatgaattctatactcagtgaaaatatctttcaaaaatgaaggtgaaataagatttttcctggtcaacaaaaagagttttatcaaacataggcacaacaaatgatgtcaaaattgattcctcttgcaaaaggaatgataacaggctgactttctttctttctttctttttttttttttttttgagactaagtatctctttgtcacccaggctggagtgcagtggcggggtctcagctcactgcaacctcttcctctgaggttcaagcgattctcctgcctcagccaccctagaagctaggactacaggcgcctgccaccacgcccagctaattttttgtatttttagtagagacagcgtttcaccatgttggccaggatggtcttgatctcctgacctcgtgatcagcccgcctcggcctcccaaagtgctgggattacacacgcgagccaccaagcccagcctgacatttttacctatgcaaaggaataaagagcaccaaaatgggaaaagtgtgagtaaatataaaacaccctgttcttaatttttagcctctttaaaaagaaaattgagacttctggttctgtataagaagtttgaaagtaatgagggagaagaaaaggaaaaatcagttaggtaaacagttaaggctggtcctcggagaggcagcctgcctgaaaaatcgcagctacaggcaaaaatagagcagcctggggaaaactcaggatgcacctgcacagacaagcacgcaaggtccggcacagaagccttttgttcttcgtgtgattaaccagctcccagggaaaagtttccccttcttttcagacatgtatgcagtgggctcggtgggaacttgcacagggaggagggggcttccctaaaacaaacccacagttttacaaacaagagaagcggtgctttgtgcttgcctagagtcatacccacagctacacagacaagggggagggagttgagcagacagcttttcagatgaagaaaagttacgcaaacagctacagaactgagaggagtttcttatacaaacttttgggattcaactgtaaaaacggaaaaccacttggctccccgctcccctgcagagagctttcattttttgttcattacactttcactccaacctcaccattttcattttcacccatgctccttaattttctcagtcatgagacaataagctgagataacaccttagacaacaagttaggacaaagtgtccttttgaaacagacaatgagatgcagaagggcactgggctcctgtctttccagggcaaggacaagtcgggctcagctgtgtgcaacttgttcactaaagggctctgtgagaaacggaaactgccccttctggcatgaccaagggaagatgatggtggtgtgtaagcaccggctctgggggctgtgcaagaagggcgaccactgcaagttcctgcaccggttgacctcctgcgatgcccgaatgctacttctactccacgttcccgcaccagttgacctcactgtgatgcccaaatgctgcctctactccacgttcctacaccggttgacctcaccgtgatgcccaagtgctaattctactccacgttcctgcaccggttgacctcaccgcgatgcccaagtgctaattctactccacgttcctgcaccggttgacctcaccgcgatgcccgaattctacctctactccacgttcctgtacctgttgacctcaccgcgatgcccgaatgctacttctactccgtgttcctgcaccagttgacctcaccgcgatgcccgaatgctacctgtactccacgttcctacaccggttgacctcaccacgatgctggaatgctacctgtactccacgttcctgtaccggttgacctcaccacgatgccggaatgctacctgtactccacattcctgcaccggttgacctcaccgcgatgcccgagtgctacttctactccaagttttgtctccgtgtaaatatcgccatgtccccagaataatgtgtctcaactatttcgtggcttctgccctgagggacccaagtgccaatttgctcatcccaagatgaatcttttattcaacctgagttacacgaagtcatctccaccatacccctttgctgttccagatatttaaatggtgctcaggttaacaccacttatgccagcgctgcagctctttggatacacagagacaaatgtagggatccgagaggccacttccaacgactgttgctatctattgcctctacagattattctgttctatttttattttataagtttagaaagagagtattaagcactaaaaaagaggacactttgtcctaacaattgctaaaaagctaaactgaaaaatgaacttttctcagattcattagagaagtgaagccacggggaaaaggactgcccctatattggagagacagaaaggccgatacaggaatcacagtgtgccagagcagaaagtcaagagcaagaactctttgggaatcagtggtggaatctgaactggaattgacaaatttctgtaaggtagacgtggacaagtgtgagaattagaacccccaggaggacccagtcatagagaagcagccgtacatttacatcttgtatctccaggagtttcaccaggacctgatattgaagattagggaaaaatccccttgtacttccagcagggggtggggaaaaggaaccccaggttgaaataggaaacagggcagaacattcagttttggaaaagatttcccctcaagagaaactaacagagccaaacctgctgggattttcttagagcctaagtgaggtgggcaaggggagagtcccaaccccagctgctcaagcttttctgttccacttaagaagaaggggagggtggccgggtgctgtggctcactcctgtaatcccagcactttgggaggctgaggctggcagatcacgaggtcacgagttcgagatcagcatagccaacatggtgacattccatctctactaaaaatacaaaaattagctcggcgtggtcctgggcacctgtaatcccagctactcaggaggctgaggcaggagaatggcatgaacccgggaggtggagtttgcggtgagctgagatggtgccactgcactccagcctgagtgacagagcaagactctgacttgaaaaaaaaaaaaaagaagaggagggcagaagatgagaagcattgtggcttcccagaggcatagactcactaaagacagagctaatcacagggctgagaacacttcaaggctcaccataaagttctgcgttcacaacagtgtggtatttctataaagataaaatgtagaataaaggaacagaatagagatgtcagaaacagacttatacgtagttatttttcaagatgttgccaggtaattaacaggaaagaatagtcttttcaaaaaatgatgcaaggacattgggttatttatatgaaaaagaattcatttcaacccttattttataccatttaaaaaattaaatttacatggattattaaatttatgagctaaagttcaataattcctagaagaaaacatgaccttgatttggtaatcatttcttagataggacacaaaaagaacaaattataacagaaaattgataaattgaattagtaaaaatgggaaaaaattttaaatgacttttaagaaaaggaaaggtaagccacccctagttcaaagaaacttgcacagcaggtatctgatgaaggtctgtatccagaaacataatgtatcttgattagaagaaagtaatcaactcaattaagaaataaggaaaatgggtcgggtgcggtggctcacgcctgtaatcccagcactttgagagcccaaggcaggcggatcacgaggtcaggagatagagaccatcctggccaacatggtgaaaccctgtgtctactcaaataaaaaaaaaaaaattagccgggcatggtggcacacgcctgtggtcccaactactcaggaggctgagcagggaaatcgcttgaacccaggagggggaggttgcagtgagcccaggtcacaccaccgcactccagcctgggtgacagagcaggattctgtttcaaaaaaaaaaaagaggaaatggggaaaatgtttgacacttcactaagaaacgtgtataaatggctaataaacacaagaaaagatgtacggtatcattaatcattagggaaatgtacattaaaaccaccaggagtcaccaccacacatgtagaaagcttaaaccttttaaggttgacaaacctcaaataccgatgaggaagtaaaacaaccaccattctcagacattgctgaagagaatcagaatcattcggccactttggaaaacagtacacatcatgctttacagaaagaagtggtatagaaatgagcagaggcactagtgtccctttaggaccattatattctaaagtgccaattggtaaaattattctttagttctacctggaaaatctacttctataatttaacttgtaattctgatctatgatatctttcagaacacgcctatgtgaacttaattaaatcttggtccaaacatgcttatttttatttcttctttattttatttatttttacttattttttaaatgagaaccaggataatgagatatttcttcttttacaagaatatgaagtttacctttcatttaaaacagtactactggcaccttgtcatataaaattttacatggagttacatattctaagaacagctatctgagaaatgtgtaatttctttttcaatagttttttatgtttattatcctatgatgtatgtgaagacatatttcatatgtaattatgagattatacttaattatatttccaaaggtgaagaaatttttgtatttttattttaaaataacaatagaaaagtatttgaaatatctttttaaattctcaattatgattcataacatcttatttttatttcacttcttacttttgtgtcttttttccttccatccttcctttccttctttcttttctcatttggattatttttaactggtgcctcagttcttcttaagtatatagaacttctaaaattataagcagagaatggtctttggttcccagaaaacttagattaaagagttaaaagttactcattatcatatagagttcctcagcaggtcattttgtaatgagagcagactcagtattataatataaacctcactggtcctgtattctttacaatgaacaaccaaagaccctttatgaagcttgatatattttaaaacattcaacatagttttatttcatgtccttgctattttataaacaggccttcaatagtcacatgatgaggacttttgggataatctacctgaaatgtaccactctgccctttctgttcttctgcaaggcaaatctgaggaattttttttattgttcatttttccaagaattcctacaaactgatgtctttactgcctacaaagtagcaggattttaaaaagtcagataactctgtttgcactgatatggccaaatatttccaattttcaggttaattctccactttttaacccagacaaacaaacattggattagattttacaagatgtgcaattaagaataaatgacagttgcctctatatatcaaaaccaagcacggacacaaaaccatgcttgcactcagtcttctctgaagaaatcacattactcttttccttcttcctatttggttacttttatgaggaatgaaaccccatgttgcaaaaagaataaagaatactcttcaccattttttttttaattttgcaaatttataaataaatgggtacaatttcttactaagtttctcattttcagcctaggcagagacatacttgcagctatcttatttatctcagagaaaccagcaatgagagctttaagcctagcaaaagtcagaagacaaccaataagagattttggcataacattaaagatagaccaagctaagacaagaacgaggatttttttcaatatggataatccaggaagaaaccgcaagaataatgacttttaaaatatccaaacaaatgtaaatttctcttccccctaacccttacagaaagcaaacagaaaacatcaaaaccaattgagaaactccaagtaggcacaagcacttcaaaattaatacagaaaaggctaactttataaaatgagtaaatttcgatacagaattatattcacacaatgaatcaggattatttccaccccatacatggtctttatcaagagaaagggatgtaaagaatatgaacctaaacatcaccgttttctattttaggtgacagcattctgtgactcactagaattagaaaacagtgacattagaattagtgacaattagaagggaaaggaagaaagggaaagaatggcatcttttacttactcgtgataaaagcaacaggaaggagttggcatcagggaagatagattggacttaagctgattctcactgctataattatctactgtgtctggttttgatcctgtttactgtgtgatacttgatatcataatgaactgttgattgtgtttatgaacatttgcaaggtgctcgtttgctgctatttttcggttagaaatgttgttttgtgtgccaaaaatggcttgaccagctgaaaataattctatataatttcaatttaatagagatacactttcctaaattcaattttatgcagttttgttacaacttgctaaaccacaggaaaaagggaaaaaaaggacatactatgtatataattcccttcaaccacttcctctgcttgtacatttgttgccagaaacaattttatgatttgcgatcggcaatagcattttcaaaaaatggtaatttttttcccaaaaattaccaataattttttattctaaaagccatgacaacttgacaaaaaatatgttaaatttctagtctctttttaatgcaaatatattaaaaactaaaaatgaatttgtactcaaaaaatttctggcacagtctcccttaagaaaatccctaattggatagaataggcatgttcccataattcactattattaagaaactattggctgggcgcggtggctcacacctgtaatcccagtaccttgggaggccaaggcgggcagatcatgaggtcaagagatcgagaccatcctggttaacacggtgaaaccctgtctctactaaaaatacaaaaaattagccgggcgtggtggcaggtgcctgtagtcccagctacggggaggctgaggcaggagaatggcgtgaacccgggaggtggagcttgcagtgatccgagatggcgccactgcactccagcctgggcaacagagcaagactctgtctcaaaaaaaaaaaaaaaatagaaaagaaactattagtgagcaattaataccctagctggatctctccatcaacaacatttagtgaacatcattaggctgtgcagcttggagaaatgttcagaattatttaaaatttatccatgatgaagaataatagaattagcaatgtcatcattacctaggtacctggcctttaaaaacacaatattaacaattttatttcttcccaaaatgttgccccttttatcagtttcctgattgtgttttcagctgattttagttatttggtgctatgtaagatttaaggggtgtgtgtgtgtgtgtatcacagatattgaatgcatagcccaatgcccatatcttagttattgatatctgtataacatttatgcagaactttatggcttaaaacaacgggcacttgttatcccccagtttctgtgggacagggtttgagtcgctcagccagatattactagtgccagctcagggtctcctgtgtctgcaggtagaatgctgtcatgggccacagtcatctcaaggctccactgaggctggagcatccccttctggaactctcatggctataaaatgaagaagtcacttggttgctgttaccttgctgtgtgaacctctccacaaggttatttgagtgtcctcactaatggcatctggctttccccagagtgggcaaactctcaatagaggacaagtgaaggggaagctttttatggcttagtccctgtagtcaccccgccgttccttacacgtattcattggaatcaagccactacgtcccaccgatgttcaagggaaagggacttaggctctaattcttcaaggagaaggtgtcaaggaatttgtgaacatatttacaaatctttacaataactttttgcatacatccatgcactggtataacctagcatttatgctaataaagtgttatgtgcatgcttttggttagtgtctagatagaattttttttgtgtgtaatttactttcaatccatctgtgtccatatatttataatatgtttcttataaatggtgcataattggatcctatattgtatcctgtctcatagcttttgtcttcaagtagaatgttttcaccccttatactttttattttcttttatatatatactgctccttgcagagcagggatacccaataggcagtgtgccaagagtagcccaacccttatactttatgccattgctgatagagtgggatttatatagagaatgtttcagtttattatctatttgcactatctaattgttactttattctactgttattgccttcttttgaattaatccacttctcaatcttccattttatcccttctattagttgtttacattataattctagtggttgctctttacggcatgcacctccgacttgatagagtgtactctaaattagtataatggttttagcaattgttaaaaagtgtatgtggcctacaacattttaactccacttacagtcagtattcttttaaagttacctacacagttgtccttccttcattgctagggttctgcccctccatcttgaatcattttccatcagcgtggcatatttcctgtagtatttcttggtaattcagatctgttggtaaactttaaattttctcaatttgtaatttcttaaaaaaagttgtcatttggccttcatttttggtggttattttagcaggatttagactttcagtttgacaatatatttttctcctgaacgttacagataccatttcattcttttctgtgtatttaatttgttcaaggcaacaatactccttaaaagatgatgtgcctctttcctatgaatgtcctcacaatttttctccttacttttgaattacagcagtttgactacgacatgcctatgtgtggttttatttgtatttatcttgcttgggagttgctgagcttcataaacacatgtattttatcagttttaaggcctttatctctgcaaatactgctactgcttcactctcttggtccttcatcattagaacttcagtgcacatacatgagacattccgatcacatattttatatgtctgttgtgcgttgttttcttcttttcattctttattctctgtactaagttttggtattttctactgacctactgtagagtttattaatattgtcttctgttgtgttcagtctgttgttaaactatccaatgggtctttatatcaattaattcatgcattgaatgcacatcagttattatatcttttggttctagtgtatctattttttcttacaattccacttatacatcacaattcttccttgttcatttattttgtctcctctatttaacatatttataataattattttagttattttaaaattcttggcgtaattctaatgctattgtcgtcaatggacctactgattttgtttttttttctttgaattattggtcacatttttctgcctgtttatatgtatggtaattggctatttttaattttatacctctgacatatataaaagatggcagattattttaattttccctagaagttctcctcgttcctgtgtgaggaagatagggtgacaagctgatcactatgatgtaatcaggtctgtgcctgaggcaatttcagcaccactcagtctatttctagtttgcttctagtctgtgaatgtgcctttcatagaattttttaattgagagcctggcaattccctatctcctcaccccaccaagcaaagatggaaggatattcattattgtctttggaggatttttcatttagctcttgagattttactcatgtggctaaaaatctgacagccatcttgaggggagactggcagtgtgtttgaggacatctctcctccgtgcttcaaacacacggccagactaatcctgtcagactaatcacagtgcatctgatgagagttgattgtaattggggttttattttacattttccagttcactaaagagttggcatttaaaaaaatcatcctctcgtttataatttccatctctcagttgtaatattcttgttcttttcttttacccattttaaaattacattttctgtcttttccttatagatttgaggatctctttatatattctggaaatcattcctttgtaaattatgtcaaaagcaattacattatttccaagttcatcttgttcttttattctctttgtgatattctttaataaacaataatttttaattcgatatactcaacttcatttattaactttacagtatgttctttcttttacgtcatgcttaaaagaatttcctacttcaagatcgaaaggatactttcacttttttgtctttagtctccttgaaattgagttttgtgagtagtactaggcaggagtctaagctctttcgtttactcttcaattttccctccctcttgccctttctccatctgtcccttccttctttcctttctttcttccttcctttcctccattctcttttgccctcctttttgctcccacattctccttctccctgtccttccactttatccctctgtctctcatccttttcttttcttcttgggtcttatctctaattgtatgatcacaatttattggaaggctcattgtttttctatggttctgcacaaccatggcagtcctcaattgtctatatgaggtaatttcttggctctttattctcttttatcatttgagtgttaatgtttcattaccatactgttataaattttattatttataataaattgataacaaataattggtaaagcagcccctctcaccttgttagcattcttcaagaggattttgataattcatgaatgtttatactttgagatacattacagattcggcttataaatttacactgaacgcgtattggattttgagtgcattaaatttatagatactgttagagaagtttgaaatattattcattaactctttcaaaccatgaactagatatatcttctcatttattagaaataggtcttcctactatcttttaataaacaagcatttttataggtatcacatatcatgtttttaaatacgaccatattttcaattctattaaaaatgaagtattaaaaaatatatatttgttgacttatagaatacattttttatattgacatattttcactagcctttctaagccttattattactttacaaattgtctatagattcctttggattttctacacagacaattatataatattcaaagaaagtttgttttctttctaatctttcacacttttatctatttcctcaaaatttcaaatgtatcagttataattgattatgttggttgattgcaatgatgtcttcatatataattatttatttttactttctagtattatttgtgctttcagcaaacatttgttaatctgttagtcttttcacagagccagttcgtatgcctggatcaattgattcctgttatatcgttttcctctttttgtttctttttcacatttcttaaattgcatacataattattgccatctcttcttttataatatacattttataatacacatttgatgctataaattttcctctattgttttagccacatcacgttttcatatttagaattacagtcaattgtaaatattacttagctcaaatactttctaattttcattataatctttaagttttgtgaattatttagaggtatgttatctttctgttataaaatttaacccaatgtcattggtctagagatagaaatcaattgacaattggcaaactttgtttatgaaatgccttttgccaagtttcttaaatgattcatgagttattaaaaagaatgtatattatgcaactgttaggcgccatgttcacttgatcagctaattatgttgtttaagtattctgcgtactgtctccttactttctctctttatcttgctctcactctcatttgcttaatgaaatactaaaaagaaaacccttatccctttactgcagaaaatttggaaaatgaaatcagtaaaaaacattacttgtaatctcatcatccagtaaaattttaatgttatttttctaattaatcaattgtacctcttttgaaatatgttacatagagatttcagatataaatagatacagatagaggtggagattatagaagaaaagaaatatttttcccccatcttaggttcatggctgagacccctgtagcaaaagacagattactaagagaaacacatacaaatgtatttgatgtaagttttttatgacacggagctttcataaatggaaattgaaatatacaggtaaatctgtacattgttatgcttaggtttgaagaagagtgagtagttgtagagaaatatgattggaggacaactgtttggggaacttagcaaggcctatttgttcatgtgcttctctgtgtccttgtgtcttcagagataaggatgctcttttcttccaggtatagaagggcacattttgaatgaaagtcatacaacctgctttggagaagggcaggagaaggtccgagtaatcttcctgcttctgctgttttctcaaatgccaaggtgccatattttggggtagtgtgtcctgaaccccagagatggagatataccctggtatcccctccttgaaaatctgctaccacatcttcggggtttatttagccaaaagaagtcaggactgactgtctctaaactttagtgtcttgtcagtctactattggcaaagtttctaaaacagctatgtgttgtcactaatgaagaccagttctgtgtagtttcatacatttttttctgccctgatgatgcctggataatgatggaaagtggagccacagattttggaaaaccgcaagcatgactacaagtagaagcccattgaatatcaacaggaaaagtagttgcagtcataatccctttcttagtttggacccttttccccaaagaaatgtcccttctttttccatagggaccaactttgcacatgctgtaagagggagtcctgttaaaactccctcccccagcaatgggttgcctacttgtagattacatttgaatagctaagaagagaactcttcaacaattgctgccactcacagcctaaagtatattttcaaaagggaacattttattaacttgctaataaaagaaagagttttctttgttatttcaattggaagacagcttttctatcaaattctcatagtcttgtaataaaatagttttcgattgtctaccacgtcttaagaatcaggttgctaataaaatttagaaagataaagtattaattagtaaattgcctggattttagagaaatttaatggactatgttgattcctctttgtaaatttgtgataaacctagttaggtgtgatagttttgttttgcataggaattaatggttcagccaacacttccctgatgttcagaatagtttaaatagcataaatcaatatacagtacatgtaaaacgttggaggtcagaaactgatacctcaaaatgtagcgctttgacatgttgaactgaagtagaagcctcaggtctctctgaattcctgccaccttcccaactctcaatcctctgtctctcccaaagcagaggatggagtgttctctgaagtttcctcatttgcccaaggcttagatccacccaagaagaaagcagttaccactggtttctcccctgaggtccattaactcccatatcacaggaaaaaggactgaagtctgtcaacacagctggacagatttttgtcacaaaccattgtctggtttctaggccaaactgaccgtgccctaggccattgtatgttctccaagtccattgattttcctctgaaaatcactagccctcaaatttccatgttcctcctgtctcccctctcataaaaagaagggcatatacacatctgtatcccattgggctattgagtaatcattgtcctaagaatctccatgctgtgcatgttaataaatttgtatggcttttctgttattagcctgccttctatgagttgatttttcagcaaatcttcaaagggcaaagaggaacttttccattgtctcctacagaagcatttaaaattctgtaaaacaatgacaaaatcaaaagccatgtaaaatcgtgtgtgtttgtggtatttttagcaaaattttatttcatatttatataatccaaaattctaatataatagttctaaatcgaattttagggtccatgaactcatcctttgcacttttgaagcagaggaggactgtgacagagttagaatctcagtttctcagttccacaggctgctactcttcacatggcagctggataatgttcgattttcagtcctgtgtatttataacacatttcaacctgcagaatgcttgaaattatctgctagtcactcttctatcttgaccaacatacaaaatcattgatgtagaattcagtgttgcaaaattttgaaaaaaatagttttggtaataattttaaatatcattggcattagagtctgacagaccaaaattaactccttgtgttataattcattagcttaaaggcatgatgattgtgacaacctcactgagtcttgacttctccatttaaagataataacatgaacctaggttgcaagttcttcatgaagattaagtgacattttatatataatatgcagaaaataggtttgatatgttgtaagcatttgataaataacatttattataataattttcagcaacaataagaaagaaagtcaaggtgttcctaagagacttagaggtttaggtcctacattgcaaaaggtttagtatctgcactgttccaacagaaggagcagacatatagaactcagttcccatccttggtttatttattttgagtattcgacagaagaaaggagtcaatgaaatgagaagacctgtgcgggcaaactaaccttatgtagaatgtgtcctcttattataaaatgagaagacaaccccttttcacaactactacaaaacaatgccatacccatccattgttattaccagttatttccaactctcccctgctatttccagagtccaccttcctgtggggaaaagctaacctagaataactgtatttcctacacctgagaggccacacaagtattacattttacaaggagtaatatttttttttgcaatttctccccaatgtactttatatccatctagtccatagcagaaatagtaaaatttcaaaattcaataaaccaaaataaaaaggtctaaaagctggagccctatatagacagaattataaacgcacattattacaccattaagaaattgttttataacatttaacattattgtaacatgcctgtgttgcacaaattcatatatactatgaataaagtcacatacattaaaacatagagtatgttaaatatggtattcagttttgtaaaaccaaatttgtctgatgtgatgtttttctggaaaacacaataagaaagctttccgagtataaatgacaatgggtttttacacatatgtctagctctcaatgtgtaaatgacaatgggtttttacattcatgtctccaaactggattctgcaaattgtattctaaatgaaaaatatcgctctagtaaacaaatctcataagacagcaatttatctcaaataaatttttggccaaatgtttagtctgtaggagagaaaaagcaatatattttcctcacccatcacagagttcatagctgaaacccttgtaacaaaatacaaattaataagagaaaacatacaactttgtttaatataagttttacatgacatgggaaccttcagaaatgaagacctgaaaacccagggacaactgtgtgtttttatggacaatcgtgcagaagtgtgattggaggacaaacgggtatggtctaatggcactaaactggggggaacttatgaaggcctgtttgttcggattcttgctagagtccctgtgtgacagtccttccctctggctaaacagcaagacacttgtctcatgagggttttcaggagagaagaagcagggagaggtcacagtgaccttcctacctctgctgtttctctcaagtactagagtccatatttggggatattttgaaactcaataagtctttgctgaaatacagtgtatctatattcttttatctttaacttttgtatattacacaccattctacttttcttttttttaatttttttttttgagatggagtctcgctctgtcacccaggctggagtacagtggcgtggcgagatctcagctcactgcaagctctgcctcctgggttcatgccattctccagcctcagcctcccgagtacctgggactacaggtgcccgccaccacacccagccaattttttgtatttttttagtagagacggggtttcactgtgttagccaggatggtctcgatctcctgaccttgtgatctgtccgcctcggcctcccaaagtgttgggattataggcgtgagccatctacttttcaaataaagtgatatatttgctaaaattgtgtgtaaactaattatagcaaaatttttataaataaaattatttcaaagataaatcttacatcctacagttacacataaagagtagtgttgtatcagatctacagtgtctaacagcctttctctctgttaatgttacaaaacattgatcattggtagcccatgctactgtcattttaatacaagcccataaacttgaattttaaatgaatcacccaaatgatttttcaggtagtcatcttccagaaagattggcttgtagaattgaaattttattctacgttttctaactatcaatagttaaaatctacatctcaaaagtgagctgtcgagtcaatgaagcccgggagtttgcaggtttggctttgaggctccatgtgtttcaccgtgaataagtgtagactcacacattcaagaagcatgttccaccctgtatatgaataatagtcttcaacctgccaggcttgcggcttgataggcattatagcacactgtatattgaagacgtttattttatgtcactagaacaattactccagcgaaaatttagtttgttatgtactttgtataaaactcatgtcttctcacatgaattactgggaagccatactttttaaaaagttgtaatagaattaaagaaagttaactcctagaataatagcagaattggcaattgatattccatctagaaatggctttcaaatcttgagatgactcttaaattcaaaagtttgagagttgagaagacacattataggactttataataacagaaaaaattagctgtaggggttgtagggtagactcaggtttgtgcactgcattccatccatgttatcacaattagagacatcatctaaaaattgagtgagttggttctttttccaagagtcagtacaaactgaaattctaaagagaattttttaaaagttaaacaacttatggatgacaagtttaaaatgaaatattcaggaaaattagggcattaattaattcattcatccattcatagtatttatttggtaactattaggttctggaaaatgtgctaaaatatattaagaaataaaactttaaaagtccatactttcatgaaatttgagattatttggggactagagacaagaaatgttatcaaaaatgatgttagtggtatgataaaaagggcacagaattctatgaaagtaaatattagaagataattcaaatagaagtttcaggaaattattttgggggtacaaaataattaatagataacaaccttaagtactgaggggaactggttagataaaggagaagatgaaaagaaaagtgtttctcagggaaaagctgtatgtgagaggaggctgtgatcagataatggaaagaagctttgcaggtcaggggcaaggttcaaggtgagagagttggcagaaaggagggaatgcatcaggcgggtagcttaaagcatgccaaggattgcaaaatttagagcaatgggaaaccaccaagatttttatgctgacataattatacttgcatttttgaaatatcaatctagttgtagaattgagtctggaatgtagagtgagaactggcatgctgtgacagaggtcagacctgagagagtgggccagagaccaggaaaggtgcatgatttcaatagggagaatatgtagatatttgtgagtcatcagatgaggtgagtgaagaagatggaaatgtaaccaatggcaattaggtttcatacataagtgaatgaatactattactttttcctaaacgagaaaacactgaagagagaacctaatggagatcaatatagattcagttttggacatgttcatattttctatgagatacataaataaatctcacccatgggccacaatgggattgacataagatgtcagcaaatatataaggaaagacatgagatgcatagaaaacaaaccacaaaatagtagacacatattctaccttatcagtaattatattaatgtacatgaattgaacactgcaatttaaaggcagacactagcagataaatttttacaaatgatacaactgtatgctatctaaaagagacacactttggattcagagataggaagtaaaaggatagaaaaagacaagcaaacggtagccaaaataaacctgaagtgattatattaaagtcagacaaaatagtccagaaggtaaaatttgtagctaaagataatgaagagaatttcatgatgataaaagagtcaatccatcaggaagacataacaattataaacacatatacaagttccaaaatacatgaatcaaaacctgacagaattgaagggaaaatgtacatttcaacagccgggtttttaatatccatttcagcaatgagtatggtgattagggagaagatcaaaaagaaatagaagatgttaacaacatggtcaactaactagacctaacagacattgatggagcactttgctcaacatgagcaaaataccgattcttctcaaggaagttcaacgcacattctccaggacaggccatctgttggactgtaaaacaagcttcaataactctaaagagactgaaataacacagaatattataggtgctaaaggatgtgatgccttgcctcacccatcacaagggtcacggccaatacttctataataaaagatgagttaacaggagacaagcatgacaactttgtttaatctaagctttacatgataggagccttcaaaaataaagacctaaagacccaggggaagctatttttatgcttcctttcgatgaagaatggaccattgtgtagagatgtgattggaaaaaaaggataagatctaatgctaatagactgaggggagaaatccagcaaggcctttctggagtgaaagcataaagaaaacaaacattgaacatggattttgatccagtggcatttgatccagtgcatttttgagaagcaatcttgacagtggctaggaacaggagctgaatccctgtgcttcaattgccttatctgttaaatggggataatagtagccaccttatatggatgtcctaagaattaattgatgtaaagatttataatagtctctcggcaaacaatacaaatttaataaattgcagccaacatagttataatcatatcgattcttcagagtaaccacccagtctttgcattctcatccacacgttgccagaggagagcacaaaagcatacaaagactcgcctgaagccttgcagccacaccacacagcaccgagacctcatcaatccccctcactttctgctaaatcacctgccccacacgtgattaatgtgccccgacctctcatgtctcattttgtagtcctgatttatgtctttctgttgtgttgtgagtaatatgtttacagagggggagaaaattataatattgaagaaagggaaacaaaagtgaggcagtcaggtatgtgaaagttatagtaagatttttatgtcaatgcagctcaacatttctgctatattctgttttgtaggcagaacaaaatctctcttagttagaggctgaaatccaagggacttcgatttattccaattttcaagtagaagattttattttactcaggtaaacatagactgtgctgttacataaataaataaataaataaataaataaataaagcaagcagaaggtgcggcatagatttaaaaaactatacttggggaaaataaaattaaataaaatcatcgtcaaaagttcttgtgcactttgaaattcagattgcatcgtgagcttggattgccaatatccttcacgctgttgcttgccagactgatagctctttccattcattacagatagaaagtgactatgaagctttacaaagttacgggcaggtgcaaagctgttgatcccagcctagaagatacattttatatgcctgtgaagattgttcaaaaaaccccaactgtaacaccaagttgttagaatagtttaagaaagattaagccagagaagggagcttcattttttgtgctgacaacacttacggggttttagttgaacccagccaagaggataaattgcaaagtaattaagaggaagtctaaatccagatttgttcagtttgtttcttaggatcgttaatattaactgactttcacattcagattcacttaacttggcaaatgccatgaaaacgaaatcacataagattttgcagcctaacattctttccgaaatgggaaaagctactcagcctaagaaatatttcatttgattttgaggtgtttcacagactatgaaaaatttaatttcacaaacaagtgccaaacattttgtttgtctttgaaaaataatcatttcaagaagaaatcaatgactttcagaaataaaaccagtagccataacaactcctccaggcattttccctgaaatgagtgggtagtgactattttaaaggacattttcattgactttgctgtattatctgacactttaagaaatgtcagagggtattgtttcagggactcttatttaaattcaggttaacgttatacgcctgcttctcaggctccatccagcttcctttgtgactcagttcaataacaaataatgatgaaccattgaaccacagacatggataaagacaatcccatgtttccattacagacccaattcaatggtttcccatgttctttaattgtatggattagaatgcacagaaaaatggtatattagacattagagatttcctctcactttccccacaaaattttgacatgattctcccagaaaaaaatgcaaagtagaaatggagattcccgtgattgacagtgatgttggagcaaagcacatttccagcatctgcttgcgtgaccctggtaaagcatgggcatgtgcggttcaggctcagagaggcgtggagtttagaaaaaacagcttaatagcaaaacattcactctttgtttcatggatggaaagattaaaacgtatcaattacattgttcacaacaatttaaaaaatccagctttcttttccaagcatttctctcacatcatcagttatagtcccagactgcgaagtctagggttattcaggtcaaattatctaacatttgcaggtgccaatgatgagctagccattttgcatgataagtaatctgcaccccaattatcataacatcctcccttcttacagatggcttagccaaggaggagaaatgtaacttgcgcagattcacatagctgaatctatgtgaaatcaaaatgtttgatttcaaaacttacactttaatatcacactatgctgactctcattattcttaaagctgaattttgtaattgaggaagagttgatttcaaaatgtctcaaatcctcagctcaaattcatgggcagttttcattcacttctacacagcatacatgtgtaatatatgttatatataatatagattttattatgtaaatatagtttaaattatacatttttaaaataaaaatatgaattttctttttcattatttcaaggttttacatgtgcttagttttaaaaatgagttagcttcttttatctttaacttttgtttgttttccaaatgtctagttgagtcattccatttgagatggtaatttttaactttccttgcttacttctagagtaacaaacctttatccttaaacctctggatttggcattatttttccatctatactgaatctttattgtataggagccaggataaaaataagaataagaggaaaatattgaacagcagaatgagaaatgtatgtttgatgccatcaattcttcaaatttttcaatattattttagagagaaacatggaattatttgctgtaaaatgttaccctaaaacaacaatagaaagtgaaaaatctaaatatcacaattttcaactgctgaaataaaagaaaatatttaaaaaattgagtcaaatgtttaaaacaaattagtttttgaatggtcttaaattttaggaaagataaataattcattaaagttcaaagaatttactttctccattaccttaggtctatgcaacatattagtttacttttgaatgaggaaataattcacaaaaggttgatctttacttttagaagaaataatttaatatactataagaatgatcaaaagtttttattatgaatgaaaggcaaaatgcttgtgtaaacatttatatcttataagtaagttttctgttagtatgctgtgttctgacatcaatttgctgacactaactgggtgtcccgtaatccagtttaattctgacagttattgcctggagttagcacagacccacatattaagagcaaagtcgttcacaggactgtttccacttcagacaccagccacagctttgggtatccctaagctaccacacttctgcccagccagctacaaattcagggcttcccacaatctctttagattgaataatttgctagaatggctcacagtattcaggaaagtgctacttagaattatcatttcattataaaatttgctcaaatggctcacagtactcaggaaagtgctgcttagaattatcatttcattataaagaatatacataaactgccacatgaagaagtaatagggcaagctctaggagagtcctgagcccaggagctttcgtccctgggaagtcgtggcatgccagcatcctggttcacttacaggttcaccagtcaggaaggtcctttgagcctcaatggcccgagcttttattgaggtttcatcacctaggatgattgagtaaatcactggtcaggtgattaaattcaaccttcagcacccatgctttccccagaggtcaggctggtccagagttccaattctcgaaacacaagtttggcctttctgggtatcaatcccaatcctgaagccacctaggcaccctccatccccaccaggagctgcctcattaacataacagaaattttcccatcacgctggaaattccaagggtttttgcagctctgtaccagaaacatgggaccatgggatgaagaccagatctattttatattgtattatagatgtcctctgtgtgtttatctaggctcataattgatatggagctttaaatagttttttctgtcatatacatttcgatgttcttccactttgttgttttaaaattactttccaagatagtgaattccttgcataaggttcatattttctaaatgcacacaaattcttttgcactggtagcttaaaattgtttagtaatggtaaagatggtttgagactgagataatcacccagagaaagatatattttttccttaaaaattaggcaaagctacatagcattaagatcttttactagcagagtacattttcagatgcccctacattacataaattagtgcaagaccaatccagaaaaaaagaagtagccgatagaattatagtgtggaagtcaggcagtctttactttatactgacgtatcttttaacaattaagactaagagaaagaatgtttttcaatttgtgtatcacctcttagaaagctgaacaagtctgatatgacataggctagctaggccaattagggataaattagagaagaacacagacccaatacaggtggttcagactaatccattcgtctttcattcgtttaaacatttttattgagtgcctgtcattctagaatgacagcagttacaattctaggcatcaagagtgtagtccttaagatagaaacaaattccctgacgttggccaggtgcggtggctcacgcctgtaatcccagcactttgggaggctgaggcaggcggatcatgaggtcaggagatcgagaccatcctgggtaacacagtgaaaccccgtctctactaaaaaacacaaaaaattagccgggcgtggtggtgggcatctgtagtcccagctactcgggagcctgaggcaggagaatggcgtgaacccgggaggcggagcttgcagtgagccgggatcgcgcccctgcactacagtctaggtgacagagtgacactccctctcaaaaaaaaaaaaaaaaaaaaaaattccctgaccttatgaaatctacattcttctctaggagtcagagagaagcaaagaatgtgaaatacaatgtcaggtagtaataaatgttatgaagaaaagtaaagaaaataaagggataaagaatgatagagtgagatggtaatttagaaagggtggctaatgaggacttgtctgaatgggtaacgtttgccagagacctgaatgagatgaaagaataaaccatacaaatatctaacagaaaaacatccgaggcgaaagaacagcaagtgccaagttcttacggaggaaatgaggttggaacgtttaagggataacaaacctgtgactaaaatatggcaagtacagtagagaacaatacaagatgtggtttgagaaatggctgggtaccagttgatagaaggtctgtatagaccaaaataaacctgaaaaaaggaaaagaaaattagaaaagaacaaaggccttgattataattacctaaaattgattcattttaacatcaatttcacacaattttaataagtagtatgttccaaagaaagaaatacgtatggtcaaacagatttagaaaatgctgggttaaaaccattaagccttttttttttttattgtaaagattttttagaacatttcatcatttgatttgtgttcaatctaatacagagattgtaatcagaatttttcaaatttattgtcctgaataactttttcttctagtagattatctcccaggattagggttccactgaattcctttaggaatcattattagttgtcaaacactgtaaaaagatctgagtggcaagaggtgtgtatttaacaccaaaactagaaatgtagtttagattttatgttatttatcacttgccaagagaacatacagagagaaaagcattgaaaaaaaaaatagattacatggagtgaagttttataaggagatacagcctttagaggaactaactttccaagttaaaaaaaaaaaggtatttagttcttaaaatattccttctgccttgttttcctttctccttttttttttttttttttttttttttgagatggagtcttactctgttgcccacgctggagtgcactggcatgctctcggctcactgctccacaggttcaagcaattcttctgcctcagtctcccgaacagctgggattacaggcccgcaccaccatgcttggctaattttgttgtatttttagtagagacaaggtttcaccatattggccaggctggccttgaattcctgacctcaggtgatccacctgcctcagcctcccaaagtgctaggattacaggcgtgagccactgtgcctggctcccttctccttctgagcttttgattatacatatgttagactgtgttgtctcacagatcatgggtactctgtttttgtttgcttgtttgtttgtttccatgttttctatttgcatttcattttgggtaatttttacagacttttcaactttactaattctttcttcagctgtttggagtctactaataatcacttcagggcaatcttcatctctattaggtttttcttttctagtatttccatccaattgttttttaaatcttcatccctctgctgaaatgacctttctggtcttgcatgctgtctgctttttccattacagcctttaacatgttaatcaaggttaataaatttccaaggtttgtgcatagctaagcctgcttggctccctgggagagtgttgttttcttcttgttattttgtgtgtgtcttaagttttgtggggaaagttgggcatcttctttaaaactgtaaacatgaagttttttttcctgcttagaaatgagcatgcctttccttcttgtaggtctttagtgtggagagttgaattattaatctaattaggagttgaactgggcttaggtttgctgtgctacggtcacctctaggtaccacaggtttaaacttcctctggagatatattgggtttagggttgtggctgctttgccaggggccaggggattttttttatgtctcttccttttgcttttggtcttccctgtgacctatgcacctatgcctcagagagggtctttttcttttcttttctttttctttctttctttttttttttttttttttttgagacagggtttcactttgtgctctgtggcccaggcttcagtgtgcagtggcatgatctcaacttctgcctcccaggttcaaatgatcttcccacctcagcatcctgagtagctgggaccataggcacatgccaccatgctcagctaatttttaattttttttttttagagatgaggtctcactatgctgccaaggctggtctcaaactcctgggctcaagtgggcttcctcccttggcttcccaaagcactggcattacaggcatgagccactgggcctggcttgtctccttcttgtaagttacatattgctagagacttgctcattggcagtgtgcatgtgtggatgggtgtaacttctgttgttctggataggcctcagtcctaggcaggcagtgaacccctgggtgtcggtggggggtagccttctcagtgccctacttttcctctagctgctgtaggcctgggttccatgtgaatcctgcaccaccactccccatttcaccacatatacacagataaaaactttggtttcacaagagacatgggggaaggatcctggtgaaattccttgcttctcctacagtggttaaagttttctttccccagtctatactacaaaacaaactttctcaagattctttaattttcatctgattcaggtagaaaaattctgcaagaggatatggacttcccctatatacgtggcccttagtgctttactctgcctcagcaaggcacactcagtccccatcaatcaaccagtcacctgtgctgagctcttcgcactggtctcaatctgcccaggtaaaacagtgctggcatttcatctccccctggaggctcctctctcctcagatttcaggaccgttggttgtcctgctcagctttctggtgggttccagaaaagttgttaactcaccgtttatttggggttttgctgttgttgtaaggctagaagtgacactcatttcttctgtcttcgtggaaaacactcaacaggtaagaaaaaaagaagcaacatcaacaagcttactgaggctatcactagtttagtcacggtagcaaaacaatagatttcttatataattatcacatctgaaagtgataatataatcactattgcaaagatcaggaataaagtcattttcttatggagtcagcagattataggaatggtggctcaagcctccattgagcttgtggactagaacgacagtgaccactctttggttgtttgcttatcgtagggagcacaacaggcttccctgtgctggctgcggacatgacgacgcgctgggaacgacagcagtgggaggtgtcatgtttgcttttacacacttcttgcctctataaaagcctgaacttaaaatttaatttttttagtaaatagctctcagtgtattacaaagtgtacattcagttatccacaactaattatttctttctgtttctaatgtgccaagaactagtgcatgctaaatataagggaagatacctgattcctcaccaaaaatcttggtacataaaattgggaagaaagtaagcagcatcaatctgtttataaaatctctttgtctcagctttttcacctgtgagatagaccatcccatattattcattaatgatatttttttgtgaccagcagacttctcagtggtcagatacatgtacctcgatccttaaaggtagcaaccatcactcatagtgaccagatttgcagaggcagcctctcccttctgtcccacagaagtctacagggtatcctggggtcctcattgcccgcctctatgaaaatcccacgtcctaaatggattgtgtgtaatttctttctcatccagacccattcttccttcctggtgccttccctgccccatcttctctttcgtccctggcccagatctctaccttgtctgacgggccgtggcccttgcttcctctactacattgtgacacttgattatatcttgtcttatatctttctccaaagatttcatggatcatgtctttccaaaattactagactccctaaggggtgaagcatgtcagtcttattttgcatcctcacgctcccttgcacactgtcagacacagagcaggcatgtgacaaatgctaggttgcaacaagtctgagtttcttaatggaagaaatttagagagagaaagcgggggtgctttggtgagagatatcaactcattgagtataatgaggaaggaaccggccaaccgccgtcaattaagaagtggagcaaatgggctaaaatcgctgtaacgtgctccacctgagctttctgccgtccagggccgctctgtttcactggggtggaggctgccactgctggcagctgaagctgagcgccagggtctcttcctctcctcctcgtcctttcggatcccgggccctgcggccgcgcttccgcttcagaccccgcatcaggacccgggacacggggacttcttccgggctgcaggcgctgggcaggcgcggcgcccccgcgtggttccttcgcaggggacagcaggtttcccgccccgccgcgtgggggcgcgcgatctgccgtctgagttcaatgcgactccggaaggacgcaagggagccgcgcaggtggccagctccttaggcgtgtccgtcccagagcaccctggctttatctggtttattgctcatggttcaatcgggaaattaggcagcgtgtccccatgacagcagacgcgggtgacggctcttgcctccctccccagtgcgcacccccgctggagcgcaggagcttcctgcaggttcgcgccagctcgggcctgacactcagggcaaagcggctccaaactgcccactgagcggtccgcacacacagtccttgccctgcaggcttttcctggacgactgctgaagttctagtcgattccacagccaaaaacatggaacaccttgagcaaaaaccattatccaacattagccgttttgtttttttttttttttttttggtcaatgaacttttgttacatgaagaacagaacaaagctggatctaccatatacctggtttgaatttactggccagaacattagcaattaggttttgaccaataatatcaagtcttttcagaatatctctggggaagaaaaaactaaaacaaaatgacagcaaacaaacttcccatagcggccagattctaagtctagtgcttttaattgaaagaggagaaatttggccaactaaaactacatcatattcgtatgcgatgaaaagaagaaaataaacatttctggtcagaaatgtagatatgattaattttaaatggaatcttaattaaaatatgacaacttgaattttcaaaaaaatgtccttggccgggcgtggtggctcacacctgtaatcccagcactttgggaggccgaggtgggcggatcacctgaggtcaggagttggagaccagccggaccaacaaggagaaagaaaccccgtctctactaaaaagacaaaattagccgggcatagtggtgcatgcctataatcccaactactcgggaggctgaggcaagagaattgcttgaacccgggaggctgccgtgagccaggatcgcaccattgcactccagggtgggcaacaagagcaaaactccgtctaaaaaaaaaaaagtccttttgttatgctattttaaataaaactttaaacacttattaaaagtatggtatacatttaaagatagcttttcctcgaagaaaatgtcagcaaggaaaatccttgaattctgtaacatatggtgtttttgagtagctatattcatcatataaaagcaatttatattttcattaaagaaattcaaattttacttatttgacactaatacctacacacaggaaatttcaaacccaagaaataataaattatcgttattctagaaaacctggtaccaccttgctctaccacagccattgctgtggttttcatctttagatgtcttgggtgctgagagctggccctgcatcccaggcacattcagattctctggcaatcaacttttgtgggagaagggaagaaaatacgatggggtagagagagaagttggacactgacgcaatcaacatcaagcctcagccaacccccaaggcagtctgaaactggacaggctcttcacagttgcccagggaggccaaacagagagagtctttataccctggcaaatgctagtcatggggagacagatgccagagggagggggcctggacttcagcaagtggctttcttcagcctgaggtaattcgccaaacgtctggggaactgcagctgacagctgcgtgtctctcccagcagtcagggagtcagtctttcaacctgcaatcggagcatgcagccatttggggactttcagtttgcagagtaaggagagctttggtctggggcggaaactttgcttttctttttgttgtttttctgcttttttttctactggggagaactgtattcttaggctctgcttcttccgtgggtcccactgtcttcaggagaggccttcttggacaagcagcctcctttccttagagagcaggtcatgggatttccaaggtcacaagtaatgtctaccagacattccgtttacatacagagaagggagacaactgtctcaaaaagtctctttattaaatcatcccctggtcatcctatgtcatagccctatatttttccttttatggatttactccagagtgggaggaaacccacatttttctctgctgtcttgggctatggcttcaccttttgtttaaaaatcaatctcatctcatctgctattttccaagaacttttcaagaatctagtctattcataacaccctttctggtttttctgtgctgtgatgactttccttcttaaacctacatttattttattccattttgctcttgagcaggaagtctgtgtattaagttctggccttgattgcaaatgccaagtcagctcagtagaatggaatgggtatgggttgtggcttcaggcagacacttcactcgggtctaccacttactatgcaacttagggtcaatcacataccttttgtgagacccagggtctttttaaagtgggaatagctggtgcggtggctcatagctgtaatcccagtactttgggaggctgaggtgggcagattacttgaggtcaggagttcaagaccagcctggccaacatgctgaaaccccatctctactaaaaatacaaaaattagccgggcatggcggcgggcacctgtaatcccagctactcgggaggctagggcaggagaatggcttgaacccgggaggtggaggttgcagtgagctgagatcacgccactgcactccagactgggcaataaggcgagactcagtctcaaaaataaataaataataaaataaagttggaataatagtatgtactgcataaattagacataaggatataaaagtgcttagcataatgtttggtatagaacctgcacacaagcaatggttgtcctctcctttctttgtatttgtatccctcataacattttttgttttttgttttttgttttgttttgttttttgaaatggagtcttgctcttgtcgccgaggctggagtgcgatagacgatctctgctcactgcaacctctgcctcctgggttcaagccattctcctgccttagcctcctcagtaggtgggattacaggctcccgccacaacgcctggctaatttttgtatttttagtagagatggggtttcaccgtgttggccaggctggtcccaaactcctgatcttgtgatccacccgtctcggcctcccaaagtgctgggattgcaggtgtgagccaccatgcccggcctgtatccctcataacattaatgtgccttgtgttctcatgaaaaagaaaaactttaatacaatccaaaatccatcagaaaacgagacaaacaaccttaaagattcagcgaggcttggtttgtttctaaagtgatcgcttaggcaatagtgcctataatatcgtcaccaccaagtactgccttgaggtgtcacagaatgtcatacgtgacagtgatagcattctacattacaccctcttgcttaacatatttgtttttaacaatttttttatttctttgtaaacttgactggttaaaataaactagtattacctagaagtaggaggtcaatcaaagactaatctacagatatatgaaattcagctggagtcatttatatgtaatagttgtatgacatctgagaaatatcacaggactaggccttctacttgccagatctgtgactttgctttgagcctgtcactttgacctttagcctcagggtcccagcagaaaaccttcttaatatgtctcctgtgttagtttcttaggactgctgtaacaaaagttccacaaacttggtggttgaaacaagagaaatgttttctttcacagttcgggcagatagatgttcagagtcaaggtgtcagcagggttggttcctcctggagactctgacggagaatctattccatgtctctctctgttccctggaaagactgtatatggaaagtggtctgcaaatgccaaagcagctgagaaaccaaagaacgaggcagacaaatccagcttgtcagtagagggtgatttattggagaatttatagacagaagcgcaatcttgggtggcagcaagacaggcagataggcagatctctgcacctgttacccccagacccagggctcatagggaaaaggtgtacatcgtctgtatgaataactaagggcagctctccagaaggggcaagaatgccaggtacatcacagcctatgatttgcgcaataatgtcaaggttgacatttacacaagggacagtacgtaaagtaggaatcaggaggcattcacaagactggggttgatcagaagtcaccgtggcagattgacatcaaggtgaggtcacttttgctccccactctcctagtttctggcaatgtccagccgtccttggcgttcccggctttcggtgcattgctcccatctccacctctgtcaccattccactgtctttcctctgggagtctctttccatgtttttacctggcattctcctatgtgtctgcgtcctaattttcctcatcttattcagacaccagacattaaattagggtccatcctaattcagtccgacctcatcataacttgattacatcatcaaagaccttattcccaaataagaccactttcacaggtcctggggattcggacttcagcatatcttttggagaataaaattcaacatgtaacatttcccaaacatagaacattttacagtggctatggtagttaagatattgtgtgtcatgaatctaaaaccaagtaaccaaagatgaaatattttgagaaggattcttgaaccgcctggaattgagttggaaattatgaacaaaaggaaactgaggacagcaacgttaaagggaattggggaagacctttcttctcattcctgctcatctatgtacctctgctccattcttctctctagctgtaaatcaatgttctctgttttccattttgtgtcacagaacatggctaccgacaacgtcccagggctgaagagaaacgtcaaccaagaagataccaatatgaaccctttttaatagagagagatggagaaggagaaacctcagagacttgccttctgactttatttttccccccaaaagagatgggcttattttctgcaagaaaagaggcttagaaggcatttttaaaaggagccaatattaaagttttgtgaaagtttttctagggaaggagagttattgatggtaggatggtgtggcatgttcggtatagatgatagaagtgagggtgtgttagggcccaggtaaaggcaggacaccatgtgtgtttagtgggctgactttctcctcgtttgcttttcatcagcaatggtcaataactcctgtgtgtcagatggttactagaggaggatgttagacagctgctaggtgagcccagcatctttacatgaacaacccaaggggacactgcaagtttattcaaccttatctgtgttagagtatcttcatggccacacggtaggttgtgagatggacatataaagttttagtaaaatcacttttcagatttccttgtagatatgtctaacccttaacttccaaggaaaagcaacattttaaaaaataagtcaggccttcttagtaaatatgtgttgaattactaattttataaattgaactcacaaagaaataacatttgatttataaatatgggtatgtgtggttatttcatccttggagaaacttcaggagcgaccctttgctctttataaatccactgactcaggcagagtcataggcaacagaaagaagcccacattcttgcctcactagttcattagtttttaagcaagatatttaaaaattacctctagcacactaaaaagtactgtcttgccaaaactttagttttttttcctttctctttttgtttgtttgcaaggggcagtctaaatagaatatcaacttaaagaaggccagggcatggtaaattaatttctttataatcttattttctatttctcctttttcttattttttctttcttcttctcagttgaaatactcttttcaatatttgttaattacctatcctgatatttttaaaccatcatctccctctctccaagctttccttattctcattccccaaataatgtaagtctaaggaagcgtctttctaaaagctttcccacaggtaggtgataaaaagctgaggagattttcttctttcttttcagtgggtgttggtgtgatcagtgacgggagaaagcagcttcccgtgcagtgcagttcttgtaaagggaggagtagaggggtggtgtctgtttgatgaatagctttcattgttttttatttattttccccaaagcagtgttctccgggcagaatacttgattgtaaaagcaggagacttgtattcaccttctcgttttacattgattttctgttctgcttgaagcctttgtgtttataaatgtaaaaagaaaaaattaggaaaatctgcctgtatttcacatggtgattttgggcctgcctcttgactggggcaccagttgcctttttcataggaaagtgtagaggtgtagacttcacatccaccgtatgcactaagcttccctagaggtcatctgcctgtgggtattaaatggggctgtaatcatggtctctgctggactttattcccctgtgctcatagttttcagagtgttggtgagtgattcaagcaagtacagccaactgtgttaccagctatcacacgatgccctatttttctaccagctatcacacgatgccccatatttccttttttctcccctttctgccatccatcgggcaccagaaccctctgtcccctgattcagctatgactctccgaagcttcagggcgttgtcatgttaggggagggtggggacggacctgcatttctctcacattcagtcacatcccattagacctctgtatagaccccatgctgtactcaggatctctatcatcccattagacctctgtatagaccccatgctgtactcaggacctctccacattttcacttgcttgaacttgctgtgactctacagttttcatgcccttcgggtgagttatgccctaggatgcctcacagtttcccaaagtgagctttgtccaactgaagtcaaaacagacacctctctaatgactgtagtctgtacaatgtagatactatattcaggaaaaataaacaaaatacaaatttgtctatatatgtgtatgtgtgtgtgtatgtgtaagccccaatatgtggtgttttatagataatgggaatattttctttgaaaatatcaatcttaaagaaagatttaaaagtaagaacaaatagaaatatcttttatgcatattcatctatttttgaagtctgcaactgcaacagtggattcacctattccttgcatttctatccatttttgcctcacatgttttgatgctctgctgttaggctcctgcctgttaagcactgttacatcttcgtggagaaatgacccatttatcgtcacttaatattcttcttctttactcctgataactttccttgttctgaagtctgctctgcctaaagttcacagagttactcctgctttcttttgattagtgctagtatagtgtatctttctccacctacttactttttttttttttgagacggagtttctctctttgttgcccaggctggagtgcagtggcgcgatcttggctcactgcaacctccacctcccgggttcaagtgattctcctgtctcagcctcccgagtagctggaattacatgcacccgccaccacggccagctaatttttctacttttagtaaagatgtggtttcaccatgttggctaggctggtcttgaactcctgaccttagatgatctgcccacttcagcctcccaaagtgctgggattataggcgtgagtcactgcacctggcccatctatttacttttaatctatatgtctttatagttaaagtgagtttcttgtagacaacatatacttgggtcttattttttgatccattctgataatctttgtcttttaatagttacatttagaccattgatgttcaaggtaataacaggtatagttggattaatatcaactgtatttgtaatactttctatttgttgaccttttttttttttttttttgggacagggtttttctttgttccccaggtgagtgcagtggcgcaatcacagctcactacagtctcgacctcctgggctcaagtgatcctcccacctcagcctcccaggtagttgggactacaggcacatgccaccatgcctggccaatttttgtatttttttagagacagggttttgccatgtcgcccaggctggtctcaaacttctgagctcaagtaatccacctgcctcagcctcccaaagtgctgggattagaggtgtgagacaccacacttggcctccctggttctttgtttctatttttgtatttcactctttttctgcctttgtgtatttaattgagcattttataggattcaatttcctctcatttcttagagtttgcaatacacgtttacaaataatataaacccattttgaaacaacacttaccacttcagaatagtatgaatagcttataataacaatcctaaatcctccctcccatttcttgtatcattgctgtcactcatttcacttacatataagcatacatacatatatatacacacataagatagatacataagcatatataataaaatacattattgctgttgttattttgaacaaattgtaatctcaggccaatcaaaaataaggaaaataaagaattttaatttaccttcactcattatttaatcaatgctcttcctttcttgctataaactccagtttctgacttaaattattcatcctctccctaaagattttcttttaacatttcttttcttttgaaaatagaatcatgctttgtcattcaggatggaatgctgtggcataatcaacactcactgcacctcaacctcctgggctcaagcaatcctcccacctcagcctcccaaggagctaggactacaggcacttgctcactacaccttcaacctcctgggctcaaacagtcctcccacctcagcctcccaaggagctaggaccacaggcagttgccactatgcctggctaatttttatttttattctttgtagagacaggtgtcttggatttttggcccaggctggtctcaaattcctggactcaagtgagcctactgccctcagcctcccaaagtgctaggattacagacatgagccatcatcaaccacgttcttttagtatttcttgcaacttacagaattttttttttatctctagcatttctttttgtttttttcttaagattttcatttctctgtttacattgctcacctgtttttgcatgctgtctgctttatgcgttagggcttttagcatattaataataattgctttaaattccctgtttgataatcccaccatttttatcatgcctggttctcatgcttgctctttctcttcaatctgtatttgttttttgttctttgccttttagtatgccttgtaatttttttttttttttttgagagccagacatgtattggataaaagtagctgctgtaattaggccttttgtaatgtagtggtgaaatgttgggagagtgtaaatgttctacagtcctataattaggtctcagtcttttggtgaacctatgcctttggactgtaaccttcacaaatgtttctgatttcccactcttaagtgggggcaggatggctagatgggctatagttgagtatttctctgctctcatgtggaagctaaagttggctgcagttgtgcattttctctttcacaggttagttagactatgttaaaaccctgtcaagttaggctctatttcattcctcttcagggtagacctcattaagcagaatgcagtgccatgcatacttcaaaatggtttcttttcccctccccttgctagaagcattgggggatttttctccaatatttagaatgtgaacctggtcaaccttgagagataagaatacaaaagcatgggggctccctataactggaacttcatggaatttttaactctcagacttgttcacactgatcctccaacaatttatcaattaaagttcagatttccttaccctggcactggttcctgcagagaattttgctccagtatggtgtgattctctgtatatgcctttttgttttcaatctggaggcagcagtttgacctaatttttcttatggctcttggcatacttgttgatttttcactttttttttcaagtttatacttgttagaataaagttgtgacttccaagttcttttcatgaggaactcaagattcatctatttttaacatttttatccatttccattttccatttggctgtcctttctctgtaaatatacccatgcatatttcataagaattgggatattctctgacagaactacattacagttaccaacttcaggaaatgagattaaatcttttaatccaatcgaccatcagtattctaattctgtcaaatgacctatcaatcttttttgttttgttttgtttttgtttttgagacagagtctcactccattgcccaggctggagtgcagtgttgcaatcctggatcgctgcaacctctgcttccctggttcgagggcttctcctgcctcagcctcccaagtagctgggattacaggtgtgcacaactgcacctggctaattttttgttgttgttgtattttcagtagagtcagggtttcaccatgttggccaggctgatctcaaactcctgacctcaaatgatccatccacccctgcctcccaaagcgctgggattacaggcatgagccaccgtgcccggccaaatgacctatcaatcttttttatagtacttttctcttcattacaggatttagtctaaaatcagatgtttagtttttatgtctctttattttcttttaatctagaatatgctagaacacttccacaggattctttgtcttttatgattttggctgcttagaatattcctttgggtttttctggtgttttctcataattagatttaatttatgaattcctgaccatatcacatctggggccacatgacatcctcatgttcctcaatggcaacattactttcgatccgtctgttaagatgtcatccaatttctccactatataattattatattttcccatgctactcataagtggtccaggagaaacactttatgaccatgcaaatatcctatttttcatcaaaatattgctctggatttaatatctttgtgatttgtgcctgaactaatctttattttgatggttataaaatgatgattttctagttctgtttccagtttcgatttctagtttctagaagccggacaggttcttctttcctgctgcacagatagaatcgatttgccaagacagctgatttccaatagagaaagatgttaataaacacagagccagcgaagcagaagaccagaatttattgctcaaaacagtctctctggaaatttggagactaaggtttttaaggataacttgctgggcgggggggtagggaaatgggtaatgctgattggttgggtctaagatgaaatcatggaggctaaagctgtcttctcactgtctttagtttctgggatcacaaaaccagttgagccagtttattggttcaggtgtgcaacagctggtccaatcacatgcagggtctgaaaaataccctgaacaccaatcttaggttttacaatcatgatgttttctataggagcaattgaagaggttacaaatcttgtggtctttggctgaatggctcctgagccacaaccctcaacttgtgccaaatttgttagttttctgaaggaggcttttggtccctgagtcaggatgagattcctttccagaagaagctgttatcatctttgttttaaagttaagctaaatttcctccacaattagcttggcctatggccaagaattaacaaggacagcttggaggttagaaacaagatggagtcagttaggctggatttctttcactgtcataatttttctatgtcatatttcttttactgtcataatttctgcaaatgtggtttcagttttagcactccctacacattttctacttggggtgtaacagtctattgtcagcaaaataaaagctaggtcttaagtcaatgtgaattattggacctgaatttgtgtgcatgccgacacatatacacaccatgcacacacatatgtatatttttaaaaagataaatgcatatatatctgcatatttaatggatgagaagacttttcttctttatatcacttgtgaagagctttgttctcatatgctgatttggaaatctcagaatattttttgatcctagtattcaataatgagtaatcaatcatgaaacctctgttgaagtttatattctaaaatcgtcatttatttttaaaaattcatttgaaaacatttagttgtggctataagttgttagtagaaaaaattagaactgaaactcacttgttaccagaactaaagaaaaaaggcaaaaaggattttatctctgctttgcatccataagggaaatgaacataactaatattcggtggaacttttatgtaaaaatacagctcttgaatttgtgaaagcaaatataagccaacactccttttttttaaaaaaaaaaattggttattacctaatttacgttgtgtctacataaaccaatttaaagtctgattttaacattcagtgtgggccaagagaaggggaagaaaagtaccattaagataaaaaaggggaggggccaagatggtggaatagaaacaggtccagtctacagctcccagtgagaccaatgcagaaggtgggtgatttctgcatttccaactgaggtacccagttcatctcactgggactggttttgggtgcagcccagggagagtgagcagaagcagggtggggcatcatttcacccaggaagtgcacggagccgggggacctccctcccccagcgaggggaagtgatgagggactgtacccaccccgggtacagctttcccagtggattttttgcaatctgcaaaccaggagattctgtcgtgagcctgcaccaccagggccctggatttcaagcacaaaactggacagctgtttgggcaagcactaagctagctgcaggagttttcttcataccccagtggtgcctggaaccccagcaagacagaaccatttactctcctggaaaggaggctgaagccagggagccaagtgttcttgctcagcaggtcccactcccatggagcccagcaagctaagaaccactggcttgaaattctcactgccagcacagcagtctggagtcgacctgggatgatggagcttggtcgggggaggggcatctgccattactgagactttaggaggcgattttcctctgacagtgctaaggagactgggaggtttggattgggcagaattcaccacagtgcagtgaagcagctgcggccagactgcttctccagatttctcctcactgggaaggcatctctgaaggaaatacagcagccccagtcagaggcttacagataaaactctcatcttcctaggacatagcacctggggagaggggcagaggtgggcacagcttcagcagacttaatcttttctgcctgccggctctgaagagagcagctgatcctgacaatggggattctccaagcatagcacaccagctctgctaagggacagactgcctcttcaagtgggttcctggtccccatgcctcctaactgggagacacctcccaaaaggggtcaacagacacctcacagaggagagctccaactggcctcaaaccggtgcccctctgggacaaagcttccagaagaaggagcaggcagcaatctttgctgttcagcagcctccattgttgacacccaggtgaacagggtctggagtagacctccagcaaactccagcagacctgcagaagaggcgactgactgttagaagtaaaaactaacaaacagaaagtaacaacaacaacaacatcaacaaaaaagaacccacacaaaaaccccatccaatggtcattagcctcaaatatcaaaggtagataaatccatgaagatgatgaaaaaccagtgcaaaaacgctgaaaattccaaaagctagaatgcctcttttcctccaaatgatcgcaactgttctccagcaagggtgcaaaactggacagacaatgagattgatgaattgttagcagtaggctttagaaggtgggtaataacaaactcctctgagctaaaggagcatgttctaatccaatgcaaggaagctaagaaccttgataaaaagttacaggaactactaactagagtaatcagttcatagaggaagataaatgacctgatggagctaaaaagcacagcacgagaacttcgtgaagcatacacaagtgtcagcagctgaatcaatcaagcagaagaaaggatattagagattgaagatgaccttgctgaaataaagtgtgcagactagattacagaaaaaagaatgaaaaggaacaaacaaagcctccaagaaatatgggactaggtgaaaagaccaagcctgtgtttgattggattacctgaaagtgatggggagaatggagccaagttgagaaacacacttcaggatattatccaggagaatgtccccagcctaacaagacaggccaacatttgatttcaggaaatacacacaacacgactaagatactctatgagaagatcaacctcaagacacataatcatcagattctccaaggttgaaatgaaggaaaaaattttaagctcagccagagagaaaggttgggtcacttatgaaagaaagcccatcagactaacagtgtatctcgctgaagaaaccctgtaagccagaagagagtgggggccaatattcaacattcttaaaggaaagaattttcaacccagaatttcatatccagccaaactaagtttcataagtgaaggaggaataaattcctttccagacaagcaaatgctgagggattttgtcaacatcaggcctgccttacaagagctcccgaaggaagcactaaatatggaaaggaaaaaccagtaccagacaccacaaaaacacaccaaaatataaagacaatgacactacaaagaaactgcatcaactaatgtgcaaaataaccagctagcatcatgattacaggcccaaattcacacataacaatattagccttaaatgtaaatgggctaaatgccccaattaagacactggcaaattagataaagcgtcaagacccatcggtgtgttgtattctggagacccatctaacgtgaaaagacacacattggctcaaaataaagggatggaggaatatttaccaagcaaatggaaagcaaaaaaaagcaggggttgcaatcctggtctctgataaaacagactttaaaccaacaaagatgaaaaaagacaaagaagggtattacataatggtaaagggatcaattaaagaagaagagctaactatcctaaatacatatgcacccaatacaggggcacccagattcataaaacaagttcttagagatctataaagatatcttcaaatcttagagatcaacaaggagagctaactatcctaaatatatatgcacccaatacaggagcactcagatttataaaacaagttcttagagatctacaaagatacctacaaatcttagagatcaacaagaagagctaactatcctaaatatatatgctcccaaaacaggagcacccagattcataacacaagttcttagagatctataaagagacttacactcccacacaataatagtgggagactttgataccccactgtcaatattagacagatcaacaagacagaaaattaacaaggatactcaggacttagactcagctctggatcaagtgggcctaatagacacctacagaactctgcatcccaaatcaacagaatatacatttttctcagtcccacatggcacttattctaaaattgaccacataattggaagaaaaacactccttggcaaacgcaaatgaatggaaatcataacgaacagcctctcagaccacagtgcaatcaaattagaactcaggattaagaaactcactcaaaaccacacaactacttggaaattgaacaacctgctcctgaatgactaccgtataaataatgaaattaagggagaaaaaataagttctttgaaaccagtgataacaaagagacaacatatcagaatctctgggacacagctaaagcagtgttaagagggaaatttatagcactaaatgcccatatcagaaagctggaaagatctcaagttaacaccctaacatcacaattaaaagaactagagaagcaagagccaacaaatgcaaaagctagcagaagacaagaaataactaagattggagcagaactgaaggagatagagacacgaaaagcccttcaaaaatcagtgaatccaggagctggtttttttggggggaaagaaaaagatagaccaccagccagactaatgaagatgaaaagggagaggaatcaaatagacacaataaaaaaatgataaagaggctatcaccactgatgccacagaaatagaaactaccattagagaatactataaacacctgtacccaaataaattagaaaatctagaagaaatggataaattcctggacacatacatcctcccaagactaaaccgggaagaagtcaaatccctgaagagaccaataatcagttctgaaattgagggagtaaataatagcctaccaaccacaaaaagcccaggacaggacagattcacagccaaattctaccagaggtacaaagaagagctggtaccattccttctgaaactattacaaacaataaaaaaagagggactcctccctaactcattttatgaggccagcatcatcctgttaccaaaatctggcagagacacaacaaggaaagaaaacttcaggccaatatccatgatgaacatcgatgaaaaatcctcaataaaatactggcaaattgaatccagaaacacatcaaaaagcttacccaccaagatcaagtcatcttcatccctgggaggcaaggctggttcaacatatgcaaatcaattaatgtaatacatcacataaacagaaacaatgacaaaaactacatgattatctgaatagatgcacaaaaggccttcaataaaattcaacatcccttcatattaaaagctctcaataaactaagcattgatggaacatatctcaaaataataagagctatttatgacaaatccacagccaatatcatactgaatgtgcaaaagctggaagcattccctttgaaaactggcacaagacaaggatgccctctctcaccactcctattcaacatagtattggaagttctggctagggcagtcagacaagagaaagaaataaaagatattcaaataggaagagaggaagtcaaattgtctctgtttgcagatgacataattgtgtatttagaaaaccccatcgtctcagcccaaaacctccttaagctgataaagaacttcagcaaagtcttaggatacaaaatcgatctgcaaaaataacaagcattcttatacgtcaatcatagacaaacagagagccaagtcatgagtgaattcccattcataattgctacaaagaaaataaaatacctaggaatataacttacaagggacatgaaggacctcttcaaggagaactacagaccactgctcaaggaaataagagaggacacagacaaatggaagaaaaattccatgctcatggaggttaaggatcaatatgatgaaaacggccatactgcccaaagtaatttatagattcaatgctattcccatcaagctaccattgactttcttcacagaattagaaaaactacttgaaatctcatatggaaccaaaaaaagagcccatatagccaagaaaatcttaagcaaaaagaacgaagctggaagcatcatgctacctgacttcaaactatactacaaggctacagtaaccaaaataacatggtactggtaccaaaacagatatatagaccaatggaacagaacaaagacctcagcaataacaccacacatctatctacaaccatctgatcttcaataaacccgacaaaaacaagcaatggggaaaggatttcctatttaataataaatggtgttgggaaaactggctagccatatgcagaaaactgaaaccagaccccttccttacaccttatacaaaaattaactcaagatagattaaagacttacatgtaaaagcataaaaaccctagaagaaaacctaggcaataccattcaggacataggcatgggcaaagtctttatgactaaaacaccaaaagcaatggcaacaaaagccaaaattgacaagtgggatctaattaaactaaagagcttctgtgcagcaaaagaaactagcatcagagtgaaaaggcaacctacagaatgggagaaaatttttgcagtctacccatctgacaaaagtctaatatccagaatctacaaagactgaaacaaatttacaagaaaaaaacaacaccatcaacaagtgggcaaaggatatgaacagacacttctcaaaagaagacacttatgcggccaacaagcatatgaaaaaaagctcaacattactgatcattagagaaatgcaaatcaaaaccacaacgagacaccatctcacaccagtcagaatggcaattattaaaaagtcctgaaacaatagatgctggtgaggctgtggagaaataggaatgcctctacactgttggtgggactgtaaattagttcaaccattatggaagatagtgtggtgattcctcaaggatctagaagcagaaataccatttgacccagcaaccccattactgggaatatacccaaaggattataaatcatcctactataaagacacatgcacacatatgtttactgcagcatcatttacaatagcaaacacttggaaccaacccaaatgcccatcaatgatagactggataaagaaaatgtggcacatatacatcacggaatactatgcagccataaaaaaggatgagctcatgtcctttgcagggacatggatgaagctggaaaccatcattctcagcacactaacacaggaacagaaaaccaaacactgcgtgttctcactcataagtgggactgaacaatgagaacacatggacacagggaggggaacatcacacaccagggcctctcagggactgggggcaaggggagggagagcattaggacaaatacctaaagcacgcggggcttaaaactagatgacgggttgacaggtgcagcaaaccaccatggcacatgcatacctatgtaacaaacctgcacattctgcacatgtatcccagaacttaaagcaaataaataaataaataaataaataaataaataaataaataaaaaatgggggaagaaaaatagaggagagagggaggttatccatctatgcatctgttttttcataacaccaagtacttccatttctatgtgctaaatatatgatatttattaaaaattgaattgccattgtaatgatattaggaggtgggacctttgggaggtgattaggccatggctccaccctcatggatgggactggtagagtctggccccctcttgccttctcttaccctctccttgcccttctactcttctgccatgtgaggaacagtgttccccccctctaaagcatgcagtgtgcaaagtgtcatcttggaatcagaattgccaaatctgctggcaccttggaccttccagcctccagaaccataaataataaatttctattctttataaattgaaaaaatataaaagaagcatttcaactccttggaaatatgctacctccattgtttttggttggtgacatgcagatttgctcttttatcttgtgctttttttctcttctttcagtcattatattaaaaaggaaggcacttagttctacttaactctgttgaatgctctgtccactaacagctgaatgtctcaacaactacacagcattaggatcttggcggctcccgtgtcaacttccagcgctctaaacagtcccctgccctgtgcaatgagcatcatcaaaaagacctaccaagagaagcaaaaacaaagcaaagccttttctctgaatacactaatttaatgtattcatgtgaaagtgcttcatatcatacaattttaaggccaaagagaaagaacgtagcaaaaagttctttaaattttttgtgtgtgtatgaatagttagctaagaatcctagttgaatctctgagagttagcacacaaatgcacagacgctcgtactctgaatatggttgtattttaacaaaagataatcacatatttcttaagtaaaaacatgagttcaatatctgaattcggcacgatggggatgggagaacagaggcaaatgaatgtggttaattatgccagttaccctgaatggatactgcagtcactttcctggcagcagtaggcagcagggaagtgttagagctgctgagtccccgcagcagctggagaagctggaaaagcgagaggtgctaaagatgtttctggactggaagagggcggattccgtactttctaactgcaccctgttttcacactggtgaagacgactctgtcctcagcactcagcagtacactgtgtggtccagaggctgccattcacagttgttgggaagacgtaaaagcatgcagtgaggcctcccaatacagtatcgtgtgttgttctcttaagcctttccacttccaggtaacctactttctctttgcagaggttgctgaagtcaaaagcagctcactcccagttcactgagcttgagttccggctgcaacttggccttgagatttttgaaacgttgatatggaagataaagaaaaacgcagattcctgtcttctaaggaacaaaggctggaagacagttctgcagattctgcctttgagggattagagggatgtgcccaggaccagatcttcagttatgcaaatataccttagagaccacagtaagaaagacatcgctctgaaatgctctggtcccaaggaaaatattgctctatataataatggaaaacgttgtctgtgtatcatgctgagctgcattttattttgtacccttgagagagcttttattttcttataaataaggattggtcttgttctgggtctgaaaactgttgtgtatttttgagatgtctatttttcttttcagttgcctgtaagagattgggagccgagggcctgagggtgaagcctcgtttgtgcaggtgactgtgggactctggtgtaagtaacgctgggcccaccctggtaatgaaggaagacccaggcccaggcaggggcggtgtcacaggcacaggggctcgcaccctgggcactgacggtggctgtcgcaccagggccgctccttgcagaaacctcactgagcctgtgcctgttgagtagcttcatgaggagcggatatcaggcagagaaagcccgggcaagagagtgacacacggggcttctgcccagaacacgtgcgcccacaatcccgggagctgtacaaatcccaagcggggaagcggaggcctcgacagttcatgatgcggacatgaatgggaatgcggccgcttgccacacctccttcttcatttggggaaatgcttgaaggtttgttttgtgaatgctaggttaaggtttggaagtttattttaaaaattgacatcatggccgggcgcggtggctcacgcctgtgatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcgggagaatggcgggaacccgggaggcggagcttgcagggagccaagatggcgccaccgcactccagcctgggcgacagcgagactccgtctcaaaaaaaaaaaaaaagaaaattgacctcaggcagggtgtagtggcgcacgcctgtaatcgcagcactttagaggctaaggagagagcccagaagctcgagaccagcctgggcaacatagtgagacccccatctctaaaaataattttttaaaaattaatcgggcatggcggtagaggcctgtagttccagctacctcagaggctgaggcgggagaatcacttgagactaggaggttgagcctgctgtgagccggatggtgctactgcactccagcctgggtggcagaatggaccctgattaaaaaacaaacaaacaaaaaagatgtatcaacattagccactcagacattgttttaaaatagtttaatcttctatttgagttacaacctgaggtaactcccaatgaaggagataaattatatagaaattaaagaatttaggggaagactctgtaaaaatgtgaaagaatggaaatcagggtgcttcggtgggggaacggtccatgtgacaaatggaatgcctggaaccgggagggcgctgggtgaggacagagctgcactaagtataaatccatttataatctgtggtctgagaccagtgagaaatttacatcctccattaggttttgagaaaggctcacagattttccctaaaaacaaatgtaataaaaagataagaagtcaccaatcccctgtaaaccttgtcatgtttcaagtgaaaacgtagcccaaagtcagaggcatggacattgtccccagagagatggcccaggcagggggcacgtgggtgctgacgcttatggcagttgaggggatctggatgggctattggaaagagattgccttgctgtagcaaatccctgccagccataatttaaagggacagaagtcattagtctgcaatgtcgctgtctttgtaccaataaaacttgtatttgcctttctttgcaagcctcattgctctgtaactcaatgtcagcagtgagtgagacctgtctcagaaacagtgacaactgcaaatttcagcagcattaatgttatacacgtgcatctggtcttctgaaggttaagtaagttgggctgttttccaagctgcacctttattctcagttctgccagggaaggaaaaaatactgctgatcttctatggtccagaaagtttgtaccatttgttttctaataaaagcaacaataaacttaactcaaaagggaaattgaagttctagcctcttgtttaactgaatcaattgtttgaaatttaatcacaaagcaattgggcaagtttttctctgatttgtttggacgtaatctagcaatctgctgctaaatccttgttctttggaaaagaggtaaattcggcttggagcaccctccttacagcctgcgtgcgtctaaagctctcgtcataatttatgtgaattaccacacatttacgttttcatggaccattttgcctgaccactttgttctttattagtagtaatatacaggatctagcaatcactttttaatatctgaatatttgcataaaatctcactctcgcctcctgtggctcatgaaaatgtttcacacaaaccttaacagggctcttcctaagatgtcctgagacgccgtctagggaaataaacaattctcaccttgttatttatagaatatgtcatattaactcagtacttaatcctctacaattctttctgtgcatgcaacggaacctaatcatcacgactatgctgtgagggaggaatggcccctttattgtacagctgaggtgaataaggtttaagccacacgcagttgaagtcactgcttacaaatgcgtatctagtggggaaattggggcttgatgccattcgtttgccctccacgttttatgctcttttttctgcatgactctgcctctcatgttattatgggtctcacccctgcagtatgtggataatttgactgtttcaagtgtgatgactctgcctctcatgttattatgggtctcacccctgcagtatgtggataatttgactgtttcaagtgtgatgactctgcctctcatgttattatgggtctcacccctgcagtatgtggataatctggctatttcaagtgtggttccttaactgtgactgtaactccatttcagctcctattaagaggtgaaaaatacttccctgtctcttaacttggatggagcttgtgatttcctgtaatcaaataatctgtaatattgcatgccttctaagccctggactcaggatgcctgtggcttccaatattattttcttggaatgtttctgacactgtgtgaagaagcctagaatgaagaccacatggagagagacacctagctgtctcagtcatttcagccttgaaacttaggctcagaaatatgagagccgcccactcagaccttcacttccagccgtgctgcctgcagcctgtcccactgcagtcagcccagggcaggtgagcagaacaaatgccctgtttacctacagagttagcagaaataaaacatggtggttttggtgcagtttgttacacagcagtaaataactgatgcagcaagcattattagaaatcactgcacgaatgcataggcatgtttaaaattcattacgttaagagcaaaaaaaagtatctcatcatgatgcaaaggaaagtaacagtaggaagggttatttcctaggtccaagtgttattatttttatttcctgaattcactatgaggcatattgtgggtcaaagttttaataagattaaaaacaatatagtaggctggatgtggtggctcacacctgtaatgccagcactttgggaagctgaggtaggcagattgcttgagcccaggagttgaagactagcctggtcaacatggagaaacaccatccctacaaaaaatacaaaaattagcctggtgtggtggtgtgcacctgtagtccagctactctggaagttgaggctggagatggcttgaacccaggaagtcgaggctgcagtcagatgagatagctccactgcactccatcctgggttacagagtgagaccctgtctccaataatgataataataatgataataataatatattagtccattattaaaaatcataagggccaggtgcagtggctcacacctgtaatcccatcactttgggaggccgaggaagtcggatcacctgaggtcaggagttcaagaccagcctggccaacatggaaaaacccatctctactaaaaatacaaaaattagccagtggtggcgggcacctgtaatcccagctactccggaggctgaggcaggagaatggcttgaacacgggaggtggaagttgcagtgagctgagatcgtgccactgcactccagcctgagcaacaagagtgaaacaccgtctcaaaaaaaaaccaaaaacaaattataaacaagtttggacagaaatagggtttcagctgcattataagaatttgctgagtcttataaaatgttttttattaatttttattagaacttataatagccattctattggattgaacagcacacattttttaaaaatatattaaaaataataaagcagttggaaagtgaagcaagttgttttccagcaagccccagctttgtgctttcagaatgagcttgaggtcagtcagacttgggttcaaatcatggctcagccgctcactggctttttgatgtttggcaaattgcttaacctctctgaggcttgattccctcaagtgtaaattccttagcatagctccaaattaatgatgagattcatttgtatttaatgtttcccttattttagaacatcccatgcctatgtttcaaaaataaaatagtgcttggccgggcgcggtggctcacgcctgtagtcccagcactttgggaggccgaggcgggcagatcacgaggtcaggagatcgagaccatcctagctgacacggtgaaactctgtctctaccaaaaatacaaaaaattagccaggcgtggtggcgggtgcctgtagtcccatctgctcgggaggctgatgcaggagaatggcgtgaacctgggagtctgagcttgcagtgagtggagatcgcgccgctgcactccagcctgggtgacagagcgcgactccgtctcaaaaaataacagtaataaataaaattaaaaaataaaatcgtgccagaacccaatttggtggctacaatgacaatacagaaaatatatcctccctggtatgcacaagtttccattaattctcttggtttttcaaagtaaacaacaatattgtcttcaaataatattaactttacttccttttttccaattgtcatcatcattattttctactctgttactgccttatgaccttgcttatatgactcaggtcttttaatatgtgttacaattatgaaaagagcttagtaccttgaatatctaggaaaaaataatctgaattttaaaaatcgaatcagggataatggcaatatttcagaagtagtgagatgagatgtgatgacggcaagaactaggaagatatcttaggatatcaaaaggcatgttttagaaaaaaagcaggcaggttccaaatggctgtctaatataccctggctatggctttgtggattcagtggtgacccagtgcagatcacaggccagggcagagaggactacctctagcccagctgagcactttgcaaaaatctcagagaatgaaggttctaaagacagatattctcattcgctagcctgggtttgggatgaaatctgtattttcaaaagtgtcccagataattctttgtatagccaagctggaaaccaatggtctaattggccatgtccaacgaacgaatagacaatctttttaatagatattaaaatgtattataccctaagtaaaaaagaaacccatttataattctccatttaaaagaaagagttccaataatatagattaaaaaaagtgtcacatggttttaaacacacacacacacacacatatatatatatatatatatatatatatatatttttgagatggagtcttgctctgtcacccaggctggagtgcagtggtgtgacctcagctcactgcaacctccacctcctgagttcaagctattatcctgacttagcctcctgagtagctggtattacaggtgcgcaccaccacgtccagctaatttttgtatttttagtaaagacagggttccaccatgttggtcaggttggtctctaactcatgaccacatgatccacccacctcggcctcccaaagtgctgggattacaggtgtcagccaccacgcctggcccgcatggttatatttttatattcttctctagtttgaaacaatgtaccttgtgcaaaatatcttctgttgattattatttgtaagctgcattttaagtttacaaagtaactctacatgcgttctttcctgcggccttcacagcagctcttagacagtgggagtagcaatgcctcacacctgcctagtcttatgcatcttgtaatgcacccttacttcctttctccatataaaacttacatgtggcattcattctctcagaactgaaatatccactgcttggagttctcaaaatatatggtgttgaattccacttttgtgctttttcgtatgtcggcccctctgctgagaatttcattcctggacttttatgcgaattttattcacataaacgaaggtctctgctctgtttgcgttcctggttggattgatcagcaggacaggcagggagccaagccctcaacactgctatggcctcccacatctctgaggtacatcgatagttcccaagtgcagagacaatcctcactgcccttccctgccctcttaggggatttgttttttgcacagaacatataacaaaggaaagaacccagcttcgactttgcatagaattccgttttcaaagctctgttgtccattttcctctgcatcagcaatcctcacacctgttttcttaacctcatcataacctcaacatacacaaaagatggccttagcacaggggcgaacctcttccgaatttcctaggtttgggcatgatcctctcgctgcttcctcagactcttccctttcctcttcctctaccctccccccaccacccaaaatgttgtaatgctagtgactgtgaattacttcatagtcattttcatacctttgcatgtctgtaattaataattaaaaaataaagtgtttgcaaattttagcactttaaatagtattagtgacaaatggctggtcacgtcattattgcgtgtcacgagtcaggaccccccagggtggaatgccagcctcctgccctctgccaccctttgctgcagatgaggcaagcctgctcactccgcaggcttccgctggggctatcggctcagtggctgtggagcatgtctgtcacgcgtgctgtacagttaggccaacgattagtgatgaaggtgacaaatagacactttttgccgtgcactgagggggtcactgttagtaccacctagacaggaatgtctaaagatgctgtcaatgcaaccagcaaatgtcgaatatatttttctcgaagacaaaacagtctaatctcatgtaagaagagtccattcattcgccttgttaacatgtcttagtcctatactagagaaagcataacctgatgtcattaattgaaggatgagactctgtggttatcgtgataataagtatatgtctggtctctgcccctggttcctggcacatggctcttaaaacccttggaatctccagagacacaacagtgtcctttgtatgctaacgagatgactggtggttaaggatccctaactaacatcaagatggggcacagtcaccagaaagaccaaggactgattagtggtcgggattttcagccccgcccccaacctccaggtgagaaagagggctgaaagttgacttggtcaccagtgggcaatgatacaatcaatcatgcctatgtaatgaagtctccataaaaccccagaggactgagttcagagagcttctgaacagctgcacgcagggaagcgtctgaagggtgctgtactcagagagaacacagaagctccacacctcctcccgagtaccttgcctatgcattttcccatcacactgttctgcagactttgtaatatcctttgcaataaactggtaaacatcagtaatgtgtttccccgaattctgtgagctgtcctagcaaattaatcgaaccaaagaggggattgtggagaccccaatttacagccactcagtcagaagcacagatcacaaccaggcgcttacaactgtcatttgaagtgggagacagtcttggggactgagccctccacctgtgggatctgaggctactttcaggtaaatagtgtcagcattgagttacattgtaggacaccctgccgatgtctgctggagaattaactgattggttgttaatggggaaaaattcatacattccttttggtgaccagacatgaagtattcagtgttgcaggttgagcgtaagtatagaaaaaatagtttggttttctcttataactctacagagactccttctgtctgtctaaatttctgggggtaattacactaattgtaaacagctttgtctgctccatctggaagaaagtgctactagccataaactattcccactagagagtgatgatgtgtatggggggcatatggattggggagtggagaggggagtctgcaccctcagccctactagcaatgcaacatttggggaaagtagcgggaagggaacattctgatgccatgacagatatcttttcacacagatttattgtactagttttcaaggtaaactgttttagtagctaaacagaatttctttaaacatgtgggtaccaatttgctcctcgcgcagtgcatgtgatagtgagataaaaaccaatcacacagcatggctggagcacagaaaaacaacattttactttcttttttgagaataaatggctttgttaacacagccaaaacaattgatctttttatttgtattttattcctggtcaatattttaagggctgactggagacttgaggccctgttgggtggaattaaagtttacaacagcccacgttttccatagattatgaaggagccaagcaaacatggtctctattagaaactcaacaacctcagcccctagattaaaagaaaaatcactcaaaagcagacacacaaaatacaggaagaaggaatactgtctagatgtgagactgatttttctaagtctctctaaatttctaagtctgtctacaaatgtgctgatttgtagcttgctcaattatatgtatcatgaaattctctactctacgttctcttcttctttatacaactgtagaacagtctttgtcattcctgttttccaaacccctcaccatccaacactcccttcaactccatgtattcagaaaaaatattcctgaagagtaaaaggcaataaaattcccaaccattccacattacttctttattcagttttgcctttcagtgaagtatgatgtgggacagcaaacaaaataaatgagcgtagatgagaaaggcagtcacttttctcaactccggcaggctctccttttgacaggcattttctggctgtttcagaagttgtcatgcctggtagttgtggcccagacattgaactgtccagagaagttctcgtgctgtccaagcaaaatgcttgcatcctaattccagaatgcacaacacaacatttgtactaaaagggagagtcttcctgttcgatgatggtttcataaaaatcaggtggcactcctattttgttggatgtaatttaaaaaggtcattccgtggctgggcaccgtagctcatgcctgtaatcccagcactttgggaggcagaggcaggtggatcaaggggtcaggagttcgaaaccagcctgggcaatatggtgaaacccaatctttcataaaaatacaaaaattagctgcgcatggtggcgtgctcctgtagttccagctacttgggaggctgaggcaggagaattgcttgaacctgggagatggaggttgcagcgagcagagatctcgccactgtactccagcctgggtgacagagccagactccgtctcaagaaaaagatcattccttcatatatatatgttcatcaagatagtagacaaattaatacagaaaaagagattcttatttcatccatgaagatgcatggatacctgttcttctcacagatacacatatcctatttgttatatctgaacaaagtcttgaatattaaaacaaaaagtggatgaataaactctcgtaacatacctgcaactttagaaacgtacacatgatttagcccttagtggctctacactttcatccagctcgcagagactcagtgtttttcagaaggatcttatgtgactagaaatttaaggtagtgaatcaaacatttgccttactgtagcttaatattttaatacctctagtacattaaaaatagcatacacattcaaatttcattatatatattaaaattaaatttactttgggaattttatgatatcttcaaatcactgaagttaaaacaatggggttcaaacttatttttctattatttataaaataattttaattcatctcatctcttaaacataagacatgataatttatgtacaaaaatgtttaatgcagtgttattcatagtgttaaaaactggaaacaatgtaaatgtgtaattacacaagtataattgtgaaaaaacattattaattttttcggtaagaaaagataaaaattacctatagtcaatgataacacttttgatggtcattcttttctatgaatctgttttttaatttgatttttgaaaaaatattcacaaaaataacttttagacgaataacatatacataatttgctccatgtacatttatcatcgtaaacagctttattctttttttccttgttcaaattcacacatccaggaaggggtagaaccagatcacatatttagagcaatcttaatctaaagctaggttctttctattgactcggggaccctggggctgcgtgactctcataagtcagatcaggtacagaaccagctctacataccacaacgccctcagagagttttcagcaagtccctcctgcaagcagctttattttaaacaaataaataaatagctcgctgaaaggcaaaactgaataaagaagaaacttggaatggttaggatttgtattctcttttactcttcaagaatatatatatatgttctttacatttactgtcttttaactttctcccttcaggcactgaatttaccaggcagccaggattaccaacttagtatgattcactacagctttctccattccagtacagctatatacaaaatagagacacccatacacatttcctgttgccgtttgccttttagaagggttcatacattttatgctgacctttcattagaagggatcatacgttttatgctgactcctcggcttttgctcttctcacttgccagtgcatcagggaggcttctttgtcagcgagtgaaattctaacattcttttttagtgactgtgtatataatatttcatgatgtgtatacatctcaactatttccccactaaagggggtttccattgtttctgattgttttaacactataaataatgctgcattaaacactattgtataaaaatctttaaaacataagacttaatttctatgtcattcatcccaagaagtgaagatgttaagtcaatgatgtatgtcctggccaggcgcggtggctcacacctgcaaccccaggactttcggaggctgaggctagtggatcacctgaggtcaggagttcgagaccagcctaacacggtgaaatcccgtctctattaaaaatacaaaaattagccgggcatagtgatgggcgcctgtaatcccagctactcaggaggctgaggcaggagaagtgcttgaacctgggaggcggaggttgcagtgagccaagatcgaacgattgtactccagctgggcaacagagctagactccatcaaaaagatgtatgttctgtaaactataatagacattgcctaattacattgcaaaatagctggtacaatgtacacgcctcagaaaaaacaatgccttttcagtaaaagtagatgatatatttctatttaatgttggctaatcaaacaagtgaggataataataatgactacatttgagtatcctttctaactttacgacaattggaattttctattttgtcaattcttattgtcatttacttatagaattctggctttgagttacattttgtaagattgccctccattttaatatgaaatattttgagaaaaatattttactcctgtatattctatatttcagaatgtaaaattgatacattcaatgaaagcattcgctaggatttaaaaattgtcatttttaaatctgaaaatcctgcattgttcttggaaactgaatttcatcagtgagcaattggaaaaccttatgaatggcaagttattagtaatgtgaatgaccttatggaaaccacaattcaagacattgtggaaatgaatttggattgtccaaaaatgagacctagaactggaataggagtacaagtttctgaatggtttgtcctcctatattcataactacaacaaggattaaatatttttttcccaaattgcaagtctggaaacatttttcatgattttttaaaaaagaaaacctaacttttttttttttcttctcccaacaagctgaagcttgttgcttgactgaattcttggagataaagaatgtgccctggtacactgaaggggaaaatcagatcacttgcagctgacattactgccaaacgtcagtgaggaggccacagtcagctgggagaattttaccctttaaacatcgtccatgtcgtacttgtggagccactggcttgtataaagatagttattgagaacatttcatagcagggatgtggggaaaccatgcatgtcagaaatcgtttttattccaagatgtgcttcagctctccttctccttctcaaagctcgattctttaaagagattaaagttcagtggtacgaggccgtataaagacatctgaataattccacgatatctagacatttctgaagaaatacactcttttttaaaaagtagcagttatttatcacaattttctaatttatgatcccggattcacgactggttagggtagtaaatatttatgggaagagatgcccctggaatccacttggggaaaagagaaagaaagtcacttcccctttgaaggcagctttactcttccagcatctcgccactgtttcagcgttcctacagctgtttctgctttggacaaatattatgtttttctgaagaaacaccttatttaatgatttaatgttgtaacagtatttagagcctagtaggttctcaataaatatttattgaacgaataaacagactgtcacatcattttattaaatgagttaaaaagggccaaccaaattcatttcttaggtattagacattaaacaccaaattgtgtatagaacaggatgctgggagatgaaagctgtgccaggccttgtagcctcaccgaaaccatttgaaaaatgactaccacttttcagcccagcattttttgctattttggattttcttagttcatagcacctgtcttcatgtcacacaactggaaatgcgtgatcctttagtctctggatttttttcttaactaatacattttagatattacatcagctatatttagcatatccttttcatttatttgtattttcctcatattataggccagtttttacagtcgaatatcccagatttcacattcttataaagttgcataattcccctaattttaaaatatttattcaattggctgggtgcggtggctcacgcctataatcccagcactttgggaggccgaggagggcggatcacgaggtcaggagattgagaccatcctggctaacacggtggaacctcgtctctactaaaaatacaaaaaaattagccgggcgtggtggtgggcgcctgtagtcccagctactcgggaggctgaggcaggagaatggtgtgaacccgggaggtggagcttgcagtcagccaagatcacgcctctgcactccagcctgggtgacagaacgagactccatctcaaaaaaaaaaaaaaaaaaaaagaaatatatatatatatatatgtattcaattaatatttttggttgcatggtatgtcttagatactgaggacgtagaaatattttcttatatgtaaagagtatttacatgattaatctcttcttaaactgccactttgtatattgtgtatttttaattttcatattgaaacacttataaaaatttttcataggatttcttattaaaagtatcatagacctcagcatatcttagtaagacccttgtaaaaacaatgagacaatttgttatcttttaaaagtaaatcagcagcagaataatactaaattaataaaataagtgttataaattttgtgatgctaatattttcaaaatcaatcatatttaagaatgcaatattcaaaacctgccatggagtgcaatttcagggatgcagcttggttattttaggtttagtttttgtatcttagccatttttggaaagctacagaagtcgttgtaaaaaaccacatctattggttgttatttctacatcttcaatttcccataggaatcttataatctagttataaaccgtaatctttcctattcatctagtccttgaagactcaaaggcagtcaatttcaagcaatttatagctaggttttattgcacgactggcagctcaggatgcctcccagaggcacgtgaaactgaccaaagaaagtctccatgagccaaggtggaaggtggtttgaattcatctacttaacttcccatttcgtaagtaagatttccgtagagcccagttcataaagagagctttgtgactgaaacaaccaaaattacatcaaatcagttatgcttggaaccctgctcacttgcagaaaggcaacacaagagctctgtgcagaaattgccatattacatgatacagtttgcactttattcattcacactaacttatagtctatgaagatttaaaatatgagggtttaaagtgatttctaagatgatataaaaacgaagtatttatgtttaataaatttcctctctaggacttttgaaaaacacatatcatgaactaatttccgaccaaacactttataataaaaaaatgaaattgccttggcaaagaagaaaaattgttttcttatgaaatgacacgtttgcttttatacggcacttcagttagatgtaatgattttaatctgagagctgcaggtacatatttttctgtctttctatctacctatctacctgattttgtttacacattttagaattatttgctcaagaaaatgttaaagagaagtgacaaactctaatttaaaatataaacacctcaagagatttgctaaaatagactcaaaatgcattatgttaggaaatatttccacagagaactaatgataagtggacaagtaaaggtaaacagcttaaacatttttgttggttttactttttggcatgatggtgttaaataaaagtctcagtatttttagaaaatgctttaagcagtacattctatttttaaactatatgtctctattttaagtcatagtacgtgatatggagagatcaggttttatgttgcaagtgtattttaaacaacacattcttagtcacacatacattttaatacacattaaatttaagctgtcttactgaattttgaaataatttagtgcggctaaggatgcgttttgttttaagcatattcacaacataaaatatgatttctgaaactcgaataagagaatatttcctacctaggcactaaaaatgtcttaaaaataactcaaaaacaattctaggttcaaatccaagaatgatattaaagacaaaatatccacataggtaataggagtagtgtttattgccatttaatgggcagcagttatgatttctaagaaacttggaaggtccttttatgggaagaggacttgacctgggtcttccatcactcttgaccttttggaaagtgagcgaaagttagccaaaatacactaagaaaagtaattcagccttgtgctgactctttccacaccaaatagcacctatgtaggaagtaaatcattaagctttgaccacgtctacaaggccaaaatgactgcagcatccgcagacaagccaggctgctcatcctcattgggacatgccacacttcaaaggtgaccgagccggtatagtggcacacacctgtattcccagcaccgaagggggaggattgcttgaggctgagagtttgacccgtctggacaatgcaagcgagatccccgttttcaaccaaaacatttaaaacttagccaggcgcggtgttgtgcacctgttgtcccatcttcttggaaggctgaggtgggaggatcccttagatggccaataatctattcagactttgccttgttcatttcttcacttccttctttcattttatttaaatagattgtatgttcacatgataaaaacaattcaagggttttacaagagaaaatgaggttttatccctaaccctccattcttcaatttttttcctccagggacaaaaagtctttccagttcttttttatcctcccatggctatcttacacctggatggagagctacatttagacatcctaatttctttacacctgaattgcagcttattttgcattagtgttctgtacttttttccccactgacaatgtatcttgggaaaaaatgccatgtttctaatgttacacaagtattgcatcacatgtattcggcaagactgattgaactactttaattctgattggtctgtaagttgctattaatctacaacaaataaaggtacattatgaggagtggtgacacaggcatagtcattttcatgtagatatattaacacaggagaaaatacatttcaagctgtggaattactgagccaaattcatgtacattccaacttttatagatattgccagattgccctctttagaggttgtactaacttatatacctatcaataaggtaacaaagtgctgttctccatttgcttgaaggcaaagtactaacaaacttttctgtatttgttaatctgacaggtgaataattgtctctcatatttttactttggttttatgctataattaatgaggttgtatagcttcttcttattccatttgcactttccaatattttatccaacatcctggaacacacctgtttctcctcaatcccccaaaaatagctgctcaacagtccaactgcatatatcttttctcctcttacctttcgttctctaaataaaataaatgcattccccattagggtttggtgcaatcgacgatctttccactttacatcactttattaatttggtttcttactcaccattttcttgtcgaggccacagatcaacccatttattaacaagtctagtaataattgtaagaagtgtagccatctctgtgaagacatcaagaacaactggaacgcggagctccagcttcattcttgtcagtttcttttgagaactttctgtatacagcagaaatatcagtacccatagttcatgaatattattagactttatggattttttttttgagacagagttttgccctgatgcccaggctggagtgcagtggctcgatctcggctcactgcaacctctgcctcccgggttcaagcaattctgtgccttagcctcctgagtagctgggattacaggtacgtgccaccatgcccagctaatttttgtacttttagtagagacagggtttcaccatgttggccagactgttattgaactcctgacctcatgatccacctgccttggccttccaaagtgctgggattacagatgtaagccactgcacctagctaggttttatggttttaaaatacactagagactgctacaaaacactggacactcttcatatactttgttatttctgaaagttattattttaccagtaaatccccatttcctataagctaattagatttatttattgtcacattcaaataattctattatagaatcagtagatactgagtttataggttaaaattgttacaatttcatgtttttaaaaactttgggaaattattattatccctttaaaaataagtatgaaagtattgaattgtttcccctttaacttttaacacaaggaactataagaattggaggctatagagtgtgtttacagttgcagctataagaaattcaggtttatcagtagttactcattagaataatcactgtatttaatctaactacagataaaatataaccttagctatatacttttgtgaggtatataattaacagcatgaaggaatgaagtataaaaataatctttctagaatctacttttaatccaagtcatgtatttggcatcacacagggtgtattgtttaaattttctaaccttggttgtaagtcaacataatttcagaggtactcggtgagggtacatttgaataaggtgagccctctcagaacaaatcatcatgttcaggtacctgaatctgggaagggcttgtgatttagaaatgtatcttttatctatagcatttcagaaaggtgaaagaattttgtactagtatgagtcatactagtagaatgaccttaaaaaattatatgtcctactcatttttttaaaaaaatgctttgttcctacaaattcccaaaaaccaacctatcagttaatgtaaatataatacataatgtatcaataataataatcaagcttcagaattggtggtttgccttgaaaaaacatatatgcacttgagaaaactggaatttttttggacaaaacattaaccttcaaacttcttttgttattgtgggggccaagggaaaacttctcttttgccttctgaagatttaatgaaaatcaattgacaaaagacaatgtaataggagaaaaggcatacaaatttattaacacacgcaggaggcatacaaaatacaagagcaccaaaaaatgtccagatagttgatgcttttataccatctggaggttacagaaagtatataagcttggatcttgggaaaacaggttatggtagtaaatcagctttagacaggacagggtatgggaggcagagaagaggaggcctggcctggcctgcaaaggtggtctcattacgtagatgaaacctcccaggcagcaggactcagggggaatagatgggaaatgtctcttttggacctttaaaggcgtcactctctgccaatcttttctagatctggagaagggagggtctcagagaaagccaggctgcgtggatgtggattttccctgcaggtgcaagtcttcccaacagaagacctttgcagggctgcccatggtcacaggccctctgaacatccatcttaaaatatatcaaagaagggtattttggggtaaaatattttggtttccattatttcagtcatcttatattctttttatcttgtatatttgaagttcctactttcttcgttctacttgtttctttcagtaaaaatagaactctagtgcttggccttgaaaactgctgctagtgaaaagaatctcacagagataaggagggaaaattttgcttgctcttgacaaccgccaataaagcgtttcttacatactagcaatttctttgagttgccctaattcttccttgataagtgctcaagcctgtggtcatccaaaacctgttattttcttttatcttttctatagctgatcctacggaataaagcattgttttggtattaagaatatgtaggtgtcagattttattgaaatacatataaacttgcaaaagtttatctccgtcttatgtgttaaataaaaacataaagattaatttaggaaaacagaaaaatattaaagttcatatgcagttttgaaaactatttctttaccattcaaattaccaatatggcattatttatgattacgagagtattctatgttaaaatgtcagttaagtaaataattttattggttttctttataaagaagtactttttgtgataaaaatttctttaggtttaaacaggagaatctatttgtgtgagactattctcgcattggtatgaagaagtacccgagactggataatttataaagaaaagaggttacattggcccatggtcctgcaggctgtgtgggaagcatagcagcttctgcttttggggaggcttcaggaagcttccaatcctggcagaaggcaaaggggaagtaagcatcttacatggtaggaacaggaacacgagagatgggggggaaggtgccacctacttttaaataaccagatcttgtgagaactcactatcactatcacgggatggtactaaaccattttttgagaaattcactccatgatccaatcacctcccactgggccccacttccaacactgggaattacaattcaatgtgcgatctgggtggggacacacatccaaaccacatcactattgttatctgtaaaaatactacattacaaatcttgtaaatataacaaagggcaaattaaagtttgatgtgctatttgaagttgtttcctattacttctgagggacgatggtgttacaaattggcccctcttaatgttaacataaataaatactagctttcaaaactaattatttgttcacagtttcaactcagatgcagcctgattttcaattttaaatagtactttagtttatagtaccgtaatagaaattagcccaaataacggagtagcttgcaagaccccaaagacacatttacattctgacagaaatgtaagtattggtttaaaatgaatctttacatttgaaaaatctaagtttatttacctaaagctattaatttgaacatacgtagaggttcagtagaagaatatgtatggggaagggtttccttcaccctctgaaagttcactaaaaatcaacaaggcagattaattggagaaacacatacaaattcatttaatgtgtctacacaggagccttcagaatgaagactcgcacaggggaaactgtcattttatgcttagatttaacagtgtatggacagccaggtagaaatatggagggacacaaagggtgtgatctactgttaatagacggagcggggtcacccagcaaggcctgtctctctagactctttctggcctctctgagcagcgtccttccttctggggtgggacaagacctccctggaatggggattttatgtgctacggtcaaaaaatttctcaattttctggccagcttttacacaaaaaggcaaagggaaagttcgagtaatacttgtaggttttatggctggatttggggaaaggggatctggttggttaaaagaaaagcctttgccaaattaaattgaacagagtttaactaagcaaagaataattctcaaattgggcagcctcacaacccagagtagcttcagaggctccggcacaaccatgtggtggaagagggcttatgggcagaagacagaaagaggaagtgcaggaacagaaatattggagacagctccatgtttgctttatgtgaacacagtttgaacagttgtgcttcttggattggccaaaactcggcgattggcacaagagtagattacagtctgattacagtctgtttatacctcctttaggttatagttcactatgtgctacaaaacctttaggccgaacttaaaatatgtaaggaggcagctttaggctgaatttcattcaacaggtttgtaaaccaaaagtatctgagacatgtctcaatcaagttagaagtttattttgttaagtttaaggacaagggcccatgacacagcctcaggaggtcctgagaacatgtgccaaggtggttgggtgacagcttggctttatatgttttagagagacataagacatcaatgagtatatgtcaggtttacattcgtttggtcctgaatggcagaacaatgcaaagctgggggtggggcttataggtctaggtggactcacggatttcctgattggcaattggttgaaagggataagctctgcctgcaaagttggagtcagcttgagttaaggtaaagggggttatgaagccaaggctcttgtcatagagaggcagcctccaggtcgcaggcttcagagagaatagatgtgaggccgggtgcggtggctcacacctgtaatcccagcactttggtaggccaaggtgggtggaggtcaggagttggagagcagcctggccaacatggtgaaaccccatctctactaaaaatacaaaaattagccgggtgtggtggcaggcacctgtagtcccagctgctcaggtggttgagacaggagaatcacttgagcctgggaggcagaggttgcagtgagccaatatcatgccactgcactccagcctgggcaacagagcaagactacgtcttaaaaaaaaagaaaagaaagaaaatagatgtgaatgtctcttactcaaggtgtcagactctctgaagagacctactaaaggaaggaatagtgtctggcatattataagcactcaataaagatgtgctgtgaatatttatgagatcgtcaaagagttctcaaatcaatagtgagaatacagcttttcaaatcagcattatgatgtattatacatcaacattttacccttcctcaaacggtgctttacgtgtgggaaagaaatagctgtatttattcaatggtggattttcttcattgcattccattcagtgtctttcaatcgccagggaaacagcaggaattctcgcacaggacaatgcgtcacgacctgtggatccagcatgcattgttgcattttcccaaatgcacccagtgaaggagaatatgataatgtgaaaaacatttcacaccttgtaaacatctgaaagtggatttgacaggaaagcctgcatgttaaatcgaagatagtcttttgattccgtaaccattccgtgaaccattcgatgcagaaaaatccatgctggagaaggctccactatgcctaatgcaggatactgatggaagaatgaattattctaccgtatgttgtttaaaaggtattaaaattgtattaggaggagtggctctgtctatagccgtgggtcagtgctgacagaacttggtggccacagccagctaagacatgccaccatggggaagtaatttacgagctatggaacaagagctgaatttatttgttttctgaacctctttaaaaaatacatacagctttattgagatacaatttacttaccataaatctacttgtgggtgcaactcaatggatttttagcatacagagtgtgcaattaccaccatgatatgatatccgaacagtttcctcaccccggaaagaaatctcatgcccatcagcagttgctctgcaaacccagctcctcccatgttcttctccttcagctcccaaattagacaatcctgaatctgctttgtgtctctatggatgtgagtaatctgggcatttcaaatagagtcacatcatatgtggcctgtggtgactggcttcttttgcccggcataacattttcaaggtctatctatgttgtagcatgtaccggtagttcctcatttttatggcaaaatattccacatttagtgtgtctgtttcttagttgacagactttgggttgttttcactgtttattataaataattttgctacaaacacccatgtatgagtttctgtgtggacacgttttcatttctgttgggtatatatccaggagcaaaatacttggatcatatgggaactttatgtttaatcattaaagaaacctctagactatattccaatgtgactgtactgttttattaggttggtgcaaaagtagttgcggtttttgccatttagaagtactgacaaaaccgcaattacctttgcaccaacctaaaacatttgcaccagcagtgaacgagggtttcaatttctcctcattctctccagcacttgtgtttgttatctttttggtgacaccattctcgtggatgtgaagtggtatctttttgttagtttggtttgtagcacatgttgaaaaaacaattattttctcattgatgtgtctttgcctctttgtcaaagatcaattaaccataaatgttaggatatacttctagagtttccattctactctgctggtttgtccatccttatgccagaatcactctgcctggattaccatagcttgtagtgacttttgaaatgggtatgtgtgagttttccaatttcttccttgtttctcaggattgtttagctattctttcatttaatttatgtaactttagttttatttctagcaaagcaatacatagccatagtttaagaaattgaatacaaataattaaatgtgttttcatatttgtgacttttagatattatctattgccatccttctaaagaaacagcatttaaatttattatccatctaatcatacacacaaatacatcattttgctttttctcatgaaatatatattatatatacacaaacatacatagacatacatacacatatagtgtgtgtatataaatgtggatatatatatttagatatacatacacatcccagttatatatgcgatacacacacacacacacacacacacatacacgcataccagctatgtatagggagtatatatatcccaatgatttcttgtctaatcagtattgaaatatttacattctttgggctatttaaaaattacttgttactgaatcattttttgtacaatgtacataattttgttcttgtgtaacattttgtacttataggtgaatattgcatttttattcttaaatttcatatgcacatatcagaaatttttcctctgatatattactctaaaatatgtataatattttaaatatggcagaatatctaattatttataagattatttacttgttctttttaaattttctttgttatagagacctaatttccgagtcctccatctgtcacttgtaacttgaacagtgtctcactaatctttctctgtcaatcttgtcacatgatttaattctttttctcctaggctgtctcccctctttcgcaggccacaaaagattttctttatattttactttttatattttgggacacagtctctctgtgtcacccaggcaacttcaacctcctgcactcaagggatcctcctgcctcagtgtacaggcatgcaccaccacactcagctaatttttacctttgtgtgtgtgtgtgtggagacaggtctcactttgttgcccagggtgatctcaaactcctaggctcaagtcatactcccaccttggcctcccaaagtgctgggattacaggtgtaagtcacctctccagccttccaaaagacatttcttaattttacctctcatgttcgtaaggtgcactctttagtagctccctgagtaagagtgcactgaaggctaatacatatagcccttgtgttctgaaaaatgtcttcattcaactcccacatttgattggcagttgattgtgtataggatgatgaatcaaaaattattttgtcagaaatatgaaggcttcacatcatgttctagcttcttttttttttttgagacggagtctcgctctgtcgcccaggctggactgcaggggcgcgatctcggctcactgcaagctccgcctcccgggttcccgccattctcccgcctcagcctcccgagtagctgggactacaggcgcccgccactacgcccggctaattttttgtatttttagtagagatgaggtttcaccgtgttagccaggatggtctcgatctcctgaccttgtgatccgcccacctcggcctcccaaagtgctgggattacaggcgtgagccaccgcgcccggccatgttctagcttcttgatatcagcttctccgcatgtggtattaggttccattctgtcattctcactcctgatttgctatgtgtaactttttttcttcctgaagatttttcccagtcttagtgattccatgctttggcgttgccattttttaatttactatgacaggccctcagtggagtttccacttggaaagtcatgtctgagtatgttctgaaattttttctttgtttcttgaatatttttgccttttcctcctcttttttgagaaaatttgttttaggaatattgatgctttagatggatcttcccatttacttacttcttcatccacttttacagtttgttttctttctcttccactccactgagattttctcaatttaaacatctaaatctcctactgatttttctgctaccattgtgtgtgtgtgcataactaattatatgatcttttgaatttttaaaaaatataacatcttgttttaatgtcatggtacaatattttctttcttccaatatttccgagtgcatcagttacttatttctaggctactttcttttctggaaatatcacagtttccactaagtactttttgtttgttaatttattggggtttggcctctgtttttcttatttgaaactctcctcaaaatccggtacgtcttgtccctcagtttatatttcagaatgagatagtgacatggagaggtggaggcagtgagccaagattgcatcactgcattccagcttggaagacagagtgagaccttgtctcaaaataaaataaaataaaatttttaaacttccgggcctaaggaagaatgatgggcttatgaataatgggcttctctatagatagcgtgggtaaaatttagactttttcttttggataatcacatctagcagcatctctctggactgtcttttatcctagttaacttaccagagaaatcctttaccttcaggatgggcctatcagtctggcttctgatactcactgaccacaggaataatttaactaaatcttccagaaatcaaaattttatctgatgtaaactgttcagaaaaatcttcaacctttggagccagtgattaactgctagttttctgggttggagggtagagatcaagaggtctgacttctttcaaaatctttggatgtgttcaacttttcccactcccaagcactctgtgtctaacgcaggcttcctccgttttctgagacctgcttggaatctgccatggacattgaccagtgtcctggtttccgtctccccttacccttctcccactggtaggatgttagcctttaactttttcccacctgcaggttgcttgctatttctaaccactgtccttttcatttttgcatcctctcttttcattttttctgtctttgtaaggctgttttttcacatctttgctataatttcagtgaggtttctttggtggctccaaagtgatatgtgagaccaatctagtacatttaccacaaattcctcattttagtaatttttgtatttttagtagagaaggggtttcaccatgttggccaggctggttgcaaacttctgacctcgtgatctgcccacctctgtctcccaaagtgctgagattacagcgtgagccaccgcacccggccaagaaccaataatttttaatgtagttcagtgaatgataagcctaaagtttattagatcatacttcaataattgaagcagttggtaggtgcaggaacacgcagacctatcaaaacaatagaatttaaaatagagccacagatacagtatccattagaatttggtttgtaaaggtgtgtgaggatttcctgaagctgctgaaactcctgttcagtggtaggagttcagaagccaaatagatgatctatttatcagatgagcatagaaacagaattccaattgggaggccaaggtgggtggatcatgaagtcaggagatcgagaccatcctggctaacacggtgaaaccccatctctactgaaaatacaaaaaattacccgggcgtggtggcgggcgcctgtagtcccagctacttgggaggctgaggcaggagaaaggccagaacccgggaggcggagcttgcagtgagccgagatcgcgccaccgcactccagcctgggcgacagagtgagactccctctcaaaaaaaaaaaaaaaaagaaaagaaagaattcctagaaaatggcttctagtctttctattgatacttcaggtgagggaccctgtataactccttagttctgccaggggttattgaaaaataaaaatattcttttaaagtctttttcactttttttaatattgaccaaataaaatcatctatgtaaaagccttttacaatttattgaataatatatggatgcaatattgtttagactggaaaaaattattttttatataaacagaggaaaactgggggttacatataaagttataattgttggtagaataaatcactgggatttagaaggtaaaagtcattaggtctttgcaggttcccacttctgtgtataaataaatgattttcaataaaatgcaagttattattatacatgattgagaagaagaaagggaagagggtcaaagtttatgttttgtccatttaaagatggagacttttttgtaacatcaaggaaaaatcaaggtaagaaactggatatgcgactgtggagctcatggataggattcagttttcaggtgcacattttgggattcataaatatagaagtcatattagaagggatgaggttggaagagatcatccaggaagtaacaatgcaggaaggaagatgtcggaggacacaaatagtacatttaggagttaggggaaaaagataaacaagcaagtaagatgagaacgctaggtagccaataaggtaagaggaaaaccacggggtcgtggattccagaaaggcaagtttgaaaatgatttaatagaagagatcaattaactgcatcagatgctgctgatatgaaagagtaatttgtaatttgagggctgagaattgatcactgattttagccacatgaaggtcactggtgcccctgccgatggtttcagtggagtggaaagcatatccagctgattgcagtgtcctcaaagagaacaggaggaaagaagctggagacagagagtatggcttgaagagggaacagccaagtggaaagtggaaagtagacaaatggagaagctggagacagagagtatggcttgaagagggaacagccaagtggaaagtggaaagtagacaaatggagacatggccaaaaaaaaaggcacaatgtttgttttcataatagaaattttcaggtattgtatgctgatgagaataatccaggaaagagggaaaatattaaatttcaggagaaggagcgattgctggagcaattgagcattgatggtctcatagataactgagaaggttgactcagtatgatagagtcatgctgaacactctgggttccaaactctagcatgcagatgttttattctaaccagtaactaaactggctcatagaaggaaggaataataagcttttggtaaattataaattattgtttctctaactttatttggtttaaattaaactgttagcaggtacacagactgctctgttatctcaatggtctacgaagtttatcagtaggcattaaaaaacagcctgtcacattttatttatctgttggaagtatctcagttgccaggcgataacgctgagaatttgattaggtgactcaatttccttttaagatgactcacctaatataggaatacagaaaattccaatttcttggcaaacagtctctgaaatctcaatttgatcaactctatgagattgataaatcttaccaattaaagtattcataagtgtaacttcacagttaatatttattcatttcacacaggatttccaagtcagaaattatttatatttgagttattaaatccataaaattgaaagaattctgcttttgagataatgctttgtaagataaatacaaagttcttttgagtataattttcagttctcaaaacattttatgaaaataaaaatgaagaattgttagagtgacatcatataaaaaattatttagatggaagaaaaccatttatcaattaatagtacttgccttctgcctccaaattgttcagtgctgcatttattattttaaaacaagaaaaaaaggcattctcccttttccagttactattgctataaaccaaattacctgcaagacttagtagcttaaggacgggcacggtggctcacgcctgtaatcctagcacttttgggaggccgaggcaggcagatcacgagatcaggagtttgagaccaacctgtccaacatagtgaaaccccgtctctactaaaaaaacaaaaatttagctgggcatggtggcaggcacctgtaatcccacctactcgggaggctgaagcaggagaatggcttgaacctgggaggtggaggttgcagtgagccaagatcgcacctttgcactccagcctgggtgacagagagagactctgtgtcacaaaaaaaaaaaaaaaaagaagaagacttaggtagcttcaagcaatatgcatgtttgtaatatcacatggattgtgtgctgcagggactggggtgagtcttctgcttatgcctcaactgggccattcagccgtacttagctggtgggtgggatgaactggaaggcccacagtcgctccactcacatgtcagacaccttggtagggatggccaagatgtttggcttcgaggggggttctccaccagaccacccaaaacttgtcaatcccagagtagctggacttgttccatgatccttgactcccctcatagtgagtgtgccaagagaactagaaggaagttacatggccctttaaacaccctcagggaacttatgtgacttctgcggcattttatttgttgaagcaagcaccagcccacttagattcaaggatggggggtggacctccagctctcaagggagagagtttcaaaaggttgtggatttttgttgttgtttaaaccaccacacgccatcctcaaagattatcagataaattagttaaatactcaatgttaaagctagctacaatttcaagcaatttttatagaaagaagggatgcaaataaatataattagtaacaaatatctaaagttagcttctacctgctggaagaaatctgagaataattttgtcaaatatggtatttctttctttgacaggaatacttggctcattcccaggacctacaaaagatatttgatagtgtttctaatgattactctgtggaaaagacatgagatcaattctaataaaattaggtaggttagtaaaaagtttcacaagacttgccgtcaattcagaaggagttctaactgcatacaaacttggaatgaattctaaagatgttgaatgatagaatccgaattcaagatatatttgattaaatagagcataattttctctgcaaatcctgtccagctggacacactgtgaatacaaatttccatgttcaatacatatagaaatatcactctcagcttttgaagagttaacaggtaaaaaatctgttacatttaaagtaaaaaatagttttacactttatatttttctgaccatgaggctaaattttggttcctcttttgtgaaattattcccttcctagagaataagcatgcaagataggctttgtaaacctgaaaactgaatggaacttaaaaagatggaatatgacatagtttggatagctgtctttacctaaatctcatgttgaactgtaatcttcgatgctggagacagggtctgatgggaggtgtttgtgccatgggtgcggattcctcatggcttcgtgctgtctttgcgatagtgcgtgagttctcatgagatcccgtcttttaaatatgtgtggcacttaccccaccactcacttgctcctttgcttctgcttttgccatgtgatgtgcctgctccctcttcaccttctgccacaattgtaagcttcccgaggcctccccagaaaccaagcaagtgccagaaccatgcttcctgtaaagcctacagagctgcaagtcaattaaacatctttttaaaaaaatacattatccagtgttgggtatttctttatagcaatgcaagaatgaccttatccagaatatcatgatcataacaacaaatttaggaaatgtatatagcttagcagaagtgaaaaaagataaacaactgaattggtagtaaattcaacacgagtaccaggtagtgaaatagctgtcaaaacacctggcatttgttgcacttcattataactataaatccattagaagacagttgagatcaatgctctacaatacattaatggaaaattcctagagtagctttgttctggtttcttcattataaaaatgatattggcaaagaggcttaagtttatagaaaatcaaatggctgatgaggacatttaatccacaccatttcagaaacttgataaatatggaaaaagatcctcagaagggacttgatttccagtgacaggaagtttttagctatcaattgaatgacagctatgtctttggccccaaaccatggacccacgtatatcagaggcatttataagatcacataaagatgctggctttacatttacagaagttggccgtactgttcctccactttatcacttttgacctgttttttaattctatgcctttttgatttcagtataaccaagcgttacctcttggctcgcttcgttttgcttaagccatattcacattatttttctcttagtttgacctttagtacatcacagaatgactttctgatttgcctttaggtcctttgcaccgctgctactgtaggaggcactcccatctccatctctttctcctagcctgctagaaacaagagctctctccacttagcattttcactggaatggggtttattgtggtttaagaatctgataggggtttgaaaaggttgttcttgaatgtctttatcattttacattaaaagtgacttcgacagattgaatgttacataggcaccactatcttctctacatcttcctcctgtgagacagatctgtcttcctaatacatcaaaggtgctgccagttgacaacgatcttgaaaccgtctatatctggctaggtgttttccaacacggaaaagtgtgatcattggcaatgaacagggaaataagacaattctaagtcatattgctacattgacagaatgattgatcactgttgctggaaagaatcatgtttcagtgaagcccaccaacagcttctggtgccaagcagatgactggatgtagatttggttatataacagcccattcaggtaagaagcaatggctatccatgatagtgaatgatatgtaatgtgcccagttccaggtggagagcaagggagagaacaaaagcatctccccagaagaggtaatttctatgattttgacaaagatacagaaaacttcagaagcctatcatagttgttgtcacagaatcaccgacgttagtaactttccagtgttatgaagacacttgcttaattgctgcatttattgtgactaaaatccccaatcagccaactgtcactgttattgatcataatttggacaaaatattgaggcccaaaagtgtgttgatttttaaaaagtgtgttggcgttggtttgtgaccttaaacgtggcaccttgatatgttcacccttactattgaggacaaaatatttaaaaccaagtctataactaggtacacccgcttgggtggacaatccaatgcttaaccatttcatcaccaagatgaaatacaatcccaaaacgacaaaactgagacaaaatgctgcttcttgactctgcatagttcacaaacatgttaaagtactctatcaacattcagaccaatattgagaaacatttcttctataaagaagtctacattttgaaggattgaaaactgatgtaaagacaagcaccccaaaccccataaagaaagctttatacctggcaagtcatagagtcaaggcagtatgtgtattcccaagttccagaaatctttgcaagattcgtgcaatagtaagtaattaaaccagagtatgagccacaatacatctgtttttgatggagcagttgaacaggaaatctagttgtcagtgcagacagttgagatcagtgctctacaatacattaatggaaaattcctagagtagcttcgttctggtttcctcattaaaaaaatgatattggcaaagaggcttatgtttatagtttttcattataagtgaaaaaatgttaggcttttctgtatctggacatcactcatgtttcccttggtattaaaatggataatgaagacataattgttgtgatcaaacataatgccccatttccaccaaggagacacagaccttacattctgacaactgtttgaatttacaaagatgaggaagcaatggtgaagggaaaatcttagttggagagtctgacatttgaggcatttctcatgagtatcatagcattcttcagattgaaatcacctctgatgctaatgcctgtggcatccgtaaggtgtctgtggtgaaccaaagcataggaaatgaagcaagaattataatcaccattgacgatggctgagtaaggaacacactgagcagttagttgaggagacagaagtacagccactaaggatgaaaggcacggagactgagatgccttccaagaccttaattgaatcttacacattcagtatgaacaccacaggagacagtcaaaaaccccaagggaagatcaatgataagaataagtgaaagatgtttgacaagtgcattaaattatcaactggctggacaaaattcagacttcagggaggatgaatttgaacattggaagaatgacccagtaaagatcctcaaatcattaattatcagcagtttccaattcaggggatacgtcaggcaggacatctagcagcttctcaggggacagagctccttctagaaacacttctctgcatccaccatggataacggccaatcttccagttagtaaaaatattttaaggaaacaattttttgcaaattcattcatgtcaattgaaccacatgtaatacattcaccatgtcttaaagctattgggcattttcaatacttcatatacatagaaaatgctagtcacattgtgctttttcagtatttatgtaaacaaacatgcagaaaatttaacagtgctggggaagtggaaattagggaaaagaaggtggatttatccctgcccttttaaagtaacagatatttctaaaagtgttggaagaataaatgttttctaacagcactcctgcaacataatttaaaaacataaattactgagattatgacctgagttaaaccaatctataaatctgtctagaaactatcatgataagtggatataaaatgtattcttttaaggtattaatacagaaacatacataatttatgtaataattactgatggccatcaggtaatgtgctatatgtgtatcacttaatttgatcttaataacagccctaagaatggcctagaagtgttactaccattttttttttttccttttttttttttttttttgagacgaagtcttgctctgtcgcccaggctggagtgcagtggtgcgatctcggctcactgcaacctccacctcctgagttcaagagattctcctgcctcagcctctcgagtagctgggattacaggcacctgccaccacatctggctaattgtttcagatttttagtagagacggggtttcaccgtgttagccaggatggtcttgatctcttgactcgtgatccacccgcctcaccctcccagaggctgggattacaggcgtgagccaccgtgcccggcctaatttttgtatttttagtagaggcgggatttcaccatgttggccaggctggtcttgaactcctgacatcagagttaccaccatgttatagatgaacatactgaggcccagagaggacagggttcttgatgaaagttacccactcgagaagtgctaacctagaatagaaaatcagccaacttgattctagagttcaagtcttttgtgggttttttttttgataggagcggaggttccagtgaaaactgggaaacttgctagacaaattttaagagagctgtagcactctaaagttcgtgttcctaaccgatttttccatttctctttatatcataatgtatgtgaacagttttctgtcttcatctgttattgaataatagttgttacctattgagcattgtatttacataacatcgttttccattgctattaaaattacttaccaatctttagacgattcatctacagtaatactactgactacaattcaattgaactgtcaaaaaatcataatttcccccaaattactgaaaatacaatgttgtattttacactaaaattcttttgaaaaagtgaatgatgttaagttcatatgttcactaatatgacacagtctctttaattttccaagataggcttgaggaacaaacaaggtggaaattccctttcttttctttccttttttttttttggtgtggcacagtatcacaaggtcaggaaagccaccaacctaaatcgcatgtttagaaacgctgaaatggaagctctgagttccctggaggggtcactagccaccagaaaggctgtcttttgagtgaaatttgtgactgagatctggacaatctatgtccattaaagaccccccccacaacccacacagcttctgatcaatgttgtcgccagtgttgtcacatatttaaatggtactgtaagccctgcaatgaggattgtatcatttatctcacattaaggttaagaagctaaattaaaaatctgccaagaaatgtgacattcatgcccaatgctttactttcagttgtctttccttcctatattacttgatgtgaagttaaagtgggaagatatttgcaataaacggtgcataatattctcaaaaagtcaaagtgttatttcataaattgggactatttaatggtaaagtgtgagaaactaaaaattctcagataaaattattcactccaaatatcagtcactaacaagatggaaatactctattaaagatgatagttgtcgctggaactgtaggaaatcaaatgtatatgcaatttaaatgtaaatagggcacatactttggtcctgtccatgaatacagaccttataaaaaaaacttgtcactcagtttaaagaaaacatgctagatttggcaatgctgaaaacatccaacaactggactttgggctttctacagtccattaattttgaatgcccgcagcacaggaaactgagtagtaacatcagtgttaaagctatagagagttttaacagtgacaaaattcactgcttcaagtttaaaggcttgcttttgtgggtgtggcaattaatttatttgaaattataacagaatttatgatatgtcctctcaggaataagaaattgggaataatcataataatattctggggcagaggacctctgttgagtatcgaagaatgtgactgccattttgaagaatggtctgctttaaggggttattctgtttactcctaacaatttggtaatcacatatatattgtaatatcatctgaatttggaaaaaaatcttatttatcatgtcttgtttctttctatattgcttctcctttttacatttttattaactcatttttttccagatgatttgaattttactgagaattaagaaatgtgcatttaaaaatcacctgggcagttacaattatggtgatatataaaataatttcaatcacaataggtgtcataattgtattatcattagttctccaagaaaaaacttgttcctcccttgaatataaaccattgatattaggattatgtgtttttaatggaaaataaagtcttgtaagcttagcctttctttttcttaaaggctaatttatgttccaccacaaatgttctgatcaatcatactgcacttgtgggcaatgaaagaatgtagatgagaacggctcttggtaaagtgaaatcattcttttactttttactcataataatttgtttcataagtttgtaagacagcattttgggtcccagtcacctgccatgaaacttaaaatgttggtcaaaattacaatgaggaccaaattgtgagtatggagaattttaaatggaattaaaaatataataataccactacttgaaggggatgtattgatgcattgtgctatctttcatattttaaaatcacagagaaatatatataataatatgtgctattcttgaataatgttaatattacaatttaagtaaaaaatcaatgggatgtgttcagtatgacatttatatttatgagatatatttataatagtttaataataatgtatgatttttatatttacaataatattaacaaaaagcctttgcttaaaaggaatttgttctgatacccttgaaaataccacttttgacaaaaaaaagtaaaatccaatagcaatacaataaaatggcatattgatatttaatggtgttattttaatttgtaagattatgctaaaatgaacaaatatgaataaataaaaatgaacattctatttccaaattttgctactgttttagtattaccaattcatatccattttagaaaagaggtaatataaaatttataatttaaaaaattgtttcttattgaggtaaaatttacatatctcatctgcacagatctagagtgttgattttggtacattttgataaatatataaactcatgtaattagcatctcaatcaagatctagggtgttttcaaggtcctagaaagcgtcttcgtgcctctgctggtcagctcccatggcccaaaggcaaccgcagcttatttctatcatgatgcatttgtttcgcttattcttaccttctttccattagcatcaccaacttaagacaatgctttgaaagtcattcctgttggtgcatttatcaggattcctgcgtagtgttccactgtctgaaatgctattatttctagatactgtcctatttagatattttgggtcaacccaattttttaaaaagtttataaatatagctgttatgaacagtctcaaacaagtcttttggtggtactgttagtaaagacagagtttcaccgtgtcggccaggctggtctcaatctcctgacctcatgatgcacctgtctcagcctcccaaagtgctgggattacaggtgtgagccaccgcacctggccttgttttatttttgttttgttttcttttgtttttgttgttgttttttaagattagtacctagaaatggaatttcaaggtcataaggtcaatatatgtttaactttagaagcaactgccagttttctacagtcattatgctaaactgcaattccaccagcaggggcagagagttccttttgctctgtattcacaaaacctttttggattttagacttttttcatccatactagtgagtgtgaaatagtgtgtctacaggttacttttttgattggaaattattagagcagctttctgagttaacatggcttaacataatggccagctggtagcatgttatcaacctgtattatatcccatttgtttataaatttatacatgtacttcagaatatgtaataaatgctttataaatatttcaaatgcaaaacaatttaaaaatatacgtgaagaataaatttcaagaagacatttcagaacacacacacaaaaggtaataaaataaaaatgaaatagaaacaatcataacctgattttaaggatgtttcaatgaagtgtccttgatagccctgaattgtagaataattctgaattaaggccaagcacggtggctcacgcctataaccccagcactttgggaggccaaggtaggcagatcacttgaggtcgggagttcaagatcaacctggccaatatggtgaaactctgaatctactaaaaatacaaaaattagccgggtgtggtgacatgtacctgtagtccaggcaggagaattgcttgaacccaggaggcagaggttgcagtgagcagagattgtgccaccgcactccagtctgagcaacagagcatgattccgtctcaataaataaataaataaataaataaataaatattctgaattaaacacaattttccacctgaaatagagaattcaaaatcagcctatatctgacaattctgcattcatagcaggacatccttagtcctgcagaattaacctggacaaatcctggtggacaccaaaaatgaagcatagacagatgtagtgctctaaacttgaggttgtgataggaggtactatgtctagcaggacttatgtgaaccatgtgtgcagcacaggacacaggctaatgccaattctgagtaactcactccttttccaggaatgagtgcagaggaaaataaacggacttgtcagactttgccatctattatggaaaaacaagagtagtattgttaccgaaacacgagggattcagtctagggcctgctgcttgcttcacagaaagccagtgactgaggtaatgagtactggcaaggaagaaggctttaatcgggcgctgcagccgagaaggtgggagctcagcctcaaatccatctccaagaccaagtaaaactgcaggcttatatagcagggaagatgtgtaagaaatgtataagaaaacagcaactggggaggggcaaggaagccattatgaggaatgagaggcctggcatctcatcgtctggatgtagtgatctggtgagtttcagttctttgatattttttgagaagcctgaagctggttgcctgaggaaggaactcagataaaacaaatataagtttcgagctttaagaccagagggtcaatttctatgtttatccagaagaacttatctatgggactactgagttggtttcagtattatctttaagatttagaaaaatgactatatctagaatatatttactaggagaagaagtaaaagaagaagaggaagtgggggtaaaggaggacaaggaaagaatgagaaggggagaacaggaagagggggaagggagaagggagaaggagggggaggggaggggaaggaagaaggagaaaggttcagaaattacctgctgtgaattccacaagctataaaaagaaacatcaagagaaacataagaacatctgagatataacagtgattgtttgacttgccagttaaaaatagaaggcaccacaggggagaaaaaaaaaggaaagttaaaaataataaaagaactattgcacatagcgaaataacagaactgattatgaaaacatttagtggcttaccaattcactcagggtaaatgtcaagatatgtgctatgccttttttttcagagtatttgtactattttattttatttattttatttttttattatacttaagttctagggtacatgcgcacaacatgcaagtttgacacataggtatacatgtgccatattggtttgctgtacccatcaactcatcatttacattagttatttctcctaatgctctccctcccctagccctccaccctctaacaggccccagtgtgtgatgttcctctccctgtgtccatgtgttttcattgttcagttcccacctatgagtgagaacatgcagtgtttggttttctgtctttgtgatagtttgctgagaatgatggtttccagcttcatccatgtccctgcaaaggacatgagctcatccttttttatggctgcatagtattccatgctgtatatgtgccacattttctttatccagtctatcattgatggacatttgggttagttccaagtctttgctattgtgaatagtgctgcaataaatatacgtgtatatgcactatgtctttaatgaagattttctcccttattacctctctgatctcataatctattttttacagtttgctaagtagctcttgcctcagggcctttgcacatgcccttcactctgcctcaactgctgtttttgccaaaatatctggctgctgctttccttgcactttccaatctttactcagaagcttttcttaatgaagtgcttctttgtcatcttttctaaaagtaacaggcatcctgtactcacaccagcactttaaatccccttcttatatttttctttcagtggttgctaatatacattaccttttatatatatttatattttttattgtctgactcacctactgggccacaatctcgatgacagtgatctttatcttcagtctctggaggaatacctggcacacataggtcctcattaaataattattaatgaataagtcaatgataatataaggtacctcaacataaataccaagaactagggtcaattaattcactcagtgtagggtttctaaattcaaattttccctttaaccaacattcctttttgttgaaacacatcttattttttaaaggattactgagctatgtttcttatccaagatagtgccatccagctggcatccagctgctcttgttagaagtggtttggtagtaattctaagcaacaaaattcctgggctctgattaccttcccctcacttttaaaacagttccagaatcattgagagatctgtgcacactcaaaaagctttgaggatccaaattcaaaccaggttctatgtctaccattaaaagccctaagaatatgtcctaattttctaatgacattttatattttaagacatcaaaagcttggatttatgggccgtatactaacaatgtttagtagccaactataaagcagttaactacatttggaatgcatcttttcttctcttttttattttcctccctcaaaacaactctgtcagcttcctttataaaacagtgtcataatgcataaaaatctagtgtttggcctagagttgcatgtccacattccaggggaaagaaagtcaaagaaaaagactgcctatcagccacgattactatttataaaaaccattgttctctttcagataacagaaatgtataagtaggtaaaaaatttcttaaaccaaagtgtttacaaaataataaaaataggtattatagttcaaaaatttcatttaaatatccagttatctaattatatgaatttttcacaagtcactttaagagcatcatttgagtaactagcctccactgttttattccttagaataaggttaattgcttctcagagaacataatcttataataataaattgcaactcaccatagtgtttcttctttctcgctcaccctctcacacacacagactcacaaatgcaagaatgagacactagaataagttctatagtgttttcttagtgtaagcctcaaaacttactgttaagcaaacataaaactatggtatgtgtccttctgtattatatctcctaggaattatctagtgcaaaattgttgctcctggtatctaagtatcaattagaacagaatcattttcaagtaccataaagacctcacataacatagcttaaacaatacagagaatgtgttgcctcaggaaacaagacaacactagaggtagcaggcagctttgtgtatggatcaacttggtctccagcagctgagtttctctgctattttcttgtctgatgcactttgttccaacggcgtcttttcaggatgctttccctagtggtgataaaaggctgcaggggtttcaagccttatcccctatattagtccatttttacactgctataaaagtactccctgaggctgagtaatttataaacaaaaaggtttaattaactcacagttctgcacggctggggaggcctcagggaagttacagtcatcatggaaggtgaaggcgaaggggaagcaaggcatgtcttcacaaggcagcaggggagagagagagaaagacagagcgaggggggagctgacaaacacttttaaaccatcagatctcatgacaactcactcactatcatgagaacaacatggggaaactgcccccatgatccaatcacctcccaccaggtctctacctccacatgtggggattttaacttgagatgggatttggttgaggacacagagccaaaccataccacccttgcacaccgcagagtttagaacagaaagtttcctttcccttaaccatcaaagaaaaatcctctgtcttactctgattggaccatctggttcacatgcccattctggaatcagttattgatcaacagatcaggctattaggggcccaaatgactgttactaaaagggaaggggtgcaagaaatgcgagtttcttaatgactgtcagtcataaataaagcagatggagggtaactcaaagaaatatagcacaagtccctatctccaaaagacctaaaatctcgtgtggtttcaactgcaaatgaaaatacaaaaattagagcaggtaaaattgtaaacatttgggcattgtcataatgtaatgagagttcaaaggagagagagttcagggtggacttaggtcatagtatgcttttcatttatttatttgtttgttttgagacagggtctcactcacttgcgcagccatggagtgcggtggcacagccatggctcactgcagccttgaactcctcacctcaagagatcatcttgcctcagcctcctgagtagccaggaccacgggcacatcccaccccacctggttaattgtaaaataagtttttgtggagaaggaattgcctatgttgcccaagcaggtctcaaattcctggcttcaagtgattatcctgcctctgccttctaaagcactggaatcactggcatggtcacactttttaagaaataaacatgattcatatgaaagtagggagttttcagcagatggaagcaccattcttgacaacaacatagagatgggaattaggaaaggaatggatgagaaaaggtgaaggcgagaaccactaggatagcagatcaaggtggatgagcaacagggaggagcctgggcagattaaacaggtccagataattgagcatattgaaagacccgcaaagatgtatacttggtgtaagaaatagtatcattgccaaattgtcaatcaaataatgctatctctgttgctcttactttatggaagaataataatttgggaatatgcatattttgaacaattgattttttaaacagtgtgtgtgtgagtgtgtgtgtgtgtatatatatatgtatatacacacacttgtattcattccaaaacactgagaaagcagtatattaaattcattttacacaacttaagagcgtttattgatccagatagaaaatttctaagctacatgctgagcatgatgactaagtatctaagccaaattgtgaattactttttccatgaaaatcaaatacatatatttatatgctgtgttttcttctaaaatgcttataaaacagctgctataatcatagaacatagagtctttgccacgacacattataataaaagagttgtatttcaatttagcaagctacctaaaaaacagtattttccaagagtgaccaaggcccattccagaccctctatcatatatgctgaaattgggttataaaaatggcttacacagacttcaagaaaatgtttgttttttcaaaacaaaacctgtctagagtattggagttcatagaatcaacagtttaaaacagaacttataaaatatatagttctacacccttattaagattaaaaaattgagttgcagaacagatgtgcttgttaaaaatagatcagttaaatactcagaacttattctcaagttttaaactcagaaactctttgctgtttccatgctaccattctgtgcattggataacaaatgttgatttaagtgaatttcagtgacataataattcacaccatctactccaacttttattgacaagaaagttgtttttgacttaaacattttgtacataattccataaagctacagaacatatgaattgtgtctagaagttaaaacacttagcaagagggctgaaattcagcatccaagactggaatagctcattaggagaccacacaccgtgaggatcattgatgtttcttcctcaaacaccaggacacaagcctgtggtatttctaaaagttgctagggaaaatactacatccaaattcagctatccttggcacaggtagttccacaaatagtgacagtcatttattaacaataaacaaagcagtgaaaagacaaaatgtctttccacaagcaccagattttaatctgaaaaaacaccccagaatcaatagttaaattgctatacaagagaaatgacctataaaggctttaatttctttttatttttgtattactttagaaatatgctatgcacatgggataagaactgcttttgacatagacagggaatcagacacaaagtcttttcagaaacactctctactagaatacagattggagaaaaatacatatgcacccatgcagagagatgaatttgagcataatataattcatttttataatggcttatttgtaattaattggtttatgttccagtttattataacaatcctgaaagataaactaagaatatacaattgttcattgcagagatggaagaatctgagtcttaaagtgactaattcatgacactattgctagaaaataaagaacacaggaatagaatacaactcttttagcttaagacttatttccacaatagtgcattccttctaacaacagccagtgctcacttagataattttgaagctacagttagagaaaaatattggagttctctgtatgatgttttaatttcactggctactgcatttgtgtaattatacatttaagagaaattaaaaattgaaaaacaaatgtaaaagtaagaaacaaattgaatgatatgagttaacaaataatatgtgtaaaattaatgcttaagaaccattttccaagtgatggtttatgttttgccttctaaaatctgttctaagttcattccaacttattttccattttggttcacaatttttcagagagaactattaaaagaaaacgctactataaaagacaaggccattttttcctctcattaataatttcaaatgttcctcatgtgaaattttttgtctggtctaaaaaagaaaagataaaaaaatcttgcctagtcaagaacagaaagtgtaaaaaaaactctaaatatattgtacttctgtatatataaccaatttaacttgaggtattttaaaataggaatttatttaattttagtgacctaaaccacattatttagagtgttgtgtaaatattaaggcatttctgaaatgagtacatttaagtctggatttttgctttatattgtttctaagacatcaaagtttaggtatgtggatagtggtggttagacatactttgtatttacagctagtcttaacagagtacaaatagattaaatagtttaagatacaaaaacatgtctagaatcagttcaacagaatctccctataaacctataaatcataaaaagttctaaatgttattacgtatgtgtaaatgtatatagaattcttccctaatattgattctagttaactgaatcttctttttaaaggtataaactatataactagcttggaaagccattaaaaacaaagtatttaatagagattttacttaatataaatattagtgaaattttatgtatcaaaaagaaatattggccagaactctggcttaattccattttcacgttatatacttaaataaaagaatatcggcaaaaagtaattagaagaaacacaatagttgtgttttaaaattttaacactatttattttcacctaaatatatgaagtgcttttgtaagttgaactgctatagataactcattaactagtgaccatttaaaattaactcagataaaaataaaactcacattttcatttagaaggtctgaaaatcaaatctgaaaaatctggagtccagtgactcagcaaatattttggttgaaagcacatttatcttcaagacaaaattacacatagtaaatttggatctgttaaagtaattcccctttacttgcaagtaagacaaacatttgtaagtaaaaaatacgtctggcttaacaaggttaagaaattaaaatgtcttattgcaaagattccattgaaggggaactgattggtttcctgatactactattggtgagcaagaattaaaatgtttaagtggcttttctgttctttaaaaccctctaggtttcctttagaacaggaaacatagggaatctgagagtatgacagtatcttgaaggtcaatgagtataacttcctccataaaatgggaagtcctacagtctactagacaatgatcagttttcttttgttatatttgacaatggtataattttctccctgagctgctcattctgcatatccctgtcctcatttttttcagaggtttggagatcttagttaccatttgtccaggtaatctctacctaattacccataatgtttccaaaacacaaggagctcaatctaggtcctgttgctcgccgcacagaaagacaatgactgagatgatgagcattgccaaggaagaagctttaatcctgtgctgcagccgagaagatgggagctcaggtctcaaatccatctccctgattcactaaaactaggagtttacatagcagggaagaaatgtaacaatgtataaggaaacaggaaataggaaggggcaaggaagccatcatgatgaaagaggggtccagcatctcattgtctggatgtggtgatctgttgagtttcagttctttgaaacctttttgaggggactgaaagccatttcctgaggaaggaactcagataaaagaagtataaggttcaagctttgagataaggagggtcaatttctatgtttatctaaaaaactgtccatgagactatgagttggatttaataacagcacagaaaactgaattcagtatttccaatgtgttcgcattgtgtgcaggacagtattaccaccctaaatataatttcgtttttttgtggcatagaatcataattgtgtttttaaaatagatatgcttttggcatcacaatgagcttatcttttattaacctcccccatcctatacctgcctagttaaatttaaataaaaatacagggttatcaacttattctaattaaagttcttcttgtttgtatatcaaatacaaattttataactatgctgtctttttctcatccaagttataacagtcaagaccgaaaagggtacaaacctgaaggttctgctccagattgacatttatcccacattcagtgtgtatctttgatcattctttaattcattccataaatatttattttggatgtactctctgtgaaaaactttcatagttgttttttgcatcaatgtgaaaaacagactaataacttgagaagtttatggtctagcaacgttagcacataaatgcctcctcaacttcaacgtacattatttctagagaatgcactgtatttgtcaatacaatagatacaatctcttgtattccagattgctaatgccgctaaaggaggaggaggctggttcaatacgatacattcccactcatggtcaggtcatgctcatttccgtcttcactttctcaagttctccgcttgataacattttctaatatttttaaataaaaagcaatataaatgttatgttgacatgttcttggtttgagtattggggcatgtcttgtaacctcccacatatatcgaccaccatcattctttctttgtgagactgctaactgaaagttactaattgtgcagctggatgctgccgtatcagcgtaactcagcctgcgacttccgttgagaactccaatgcgtgctagttggttcatgcattctctacagttgtggtttcagaagttctcttttcacttttaacctcacatacccaacacctttgtctctcccagctctttcatggggatagtggaagccataaactattaagttttttttatttattttattttattattattattttttttttgagatggagttttgctcttgttgtctagattggagtgcaatggtgcgatcttggctcactgtaacctccacctcccgggttcaagctattcttctgcctcagcctcccaagtagctgggattacaggcagccgccaccacacctggctaattttgtatttttagtagagacagagtttctccatgttggtcaggctcatctcgaactgccgacctcaggtgatccacctgcctcagcctcccaaagtgctgggattacaggcatgagccacggggcctggccaaactaagaaatatttataaccaactctataaaccttcttaaatccacgctcattgcatcttccgttctctcctgttacaatggaagaggggtgctctcctctattttaggcccatttcctaaaccagttcctgattctttctttcctccctggtgacattgtactgctgtactctcttgtcagtcctatattttccatctttctctgcacatgaattcttttcttaaacaagctcgagttgctctgtgtaaatttttcttttgtgaaatagcttctatcctacctgtcccctcattctcacaccgaactgtcttttactctctcttctgcaatcctaggcagtctgacttccgtccacgacttcacaaagctgctgtactatggcccttagtgccctccttgacattaaaaacagtaaacaagtcccattttcttttttactaataactctaatttcttcatctaacaatctcacctttcttaaacatactttactttgtcatccaagccacagtgcagttttggtttttctcctaataatgtgtccccttttcccagcctgcttggtgggggccccttcctgaaccaaactgtcgttaatggtgcccttaagcttcacttcccactctgcgttctctgtgcaccatctttaagatctatatttcttgacagaacatttacgtcatgagttcatctgtctccccaacacctttaggtgtcatagctgactgctggtggatatctccatctggacgtcacatgggaacttcaaactcaatatattcaacactgaactcattagctcaactctgctgctgcctctgtctgtcacatgccccacacaattgctctccctcttgtattctatttcagtgaaaatagagtccatttgaaaaattggaacattggtgactcctgtgcgattccccaaacaagcattacgttgtcagttttaccttataaatactttttgaattatatttatcaattccagatcatcaaatcttacctatattttgcaacaatcttttaattagcccttgtgcttccaatctttgtcttttttctttctctacaatgacgccaagggtttcataaaatgtgaaccggattttaccaattttctgcctaagttttccatgagtttccattatgagtgggataacattcaaatttcttgatgtgactttataaagccaaaaatgaaataagaaatattagaattagttttgacaaggagttaatgaacttaggggattccaaactttaaagaacatttacctttacttgtcctctgaccccattatcaaaacattcccacaaaataatcttgtattagttaattatactctggaaggaatttacagcttctcaaagatgattgctttttacgccatctctactctcactggcacgaggctgttttcttttacatgaagtctcccattgttcacataatcatattactttctcgcagcttggctttagaaatagaacatagctaaactttggacccttaagtgattgcctggaggcattaggtctataatttcaatactaaaaagctcttcaaatcataaatatcctaatagatttgtgacaaattatggcagcaaaacctattctgatctgacgttaagttacacctgctttttatttatcacacctagtttgaatattcatacatttcactgtatcaatattaatgtatttgaatgtggggtgctgatccagacataatacatgatatatgcacaccattaccttcctaaaatatgaaaacctccaaaatctaaaaggttttggcctcaaggcccttggattaggaattctgagtttatactaaatttagtatggcaaatcaaagcctatcaaacttcagatttgtgggatttatttatccaagaagaaaataggtctctctctttttttaattagacagagtcttgctctgtcacccagggtggagcgcagtggtgtgatctaagctcactgcaacttccacctcgcgggttcaagtgattctcctgcctctgcttccccagtagcgcctccatgcccagctaatttttgtatttttagttgagacagggtttcaccatgttggccaggatggtcttgaactcctgacctcaggtgatctgcccaccttagcctcccaaagttcagggattacaggcgtgagtcagcgtgtctggacagaaagtagatctcttgatttcctatgagattcactgaaagaatgtgtttaaaagggatcttacatttagagaataagttgatgcacacattttcagaatttctattttatccatttgggctgagtttggtgccttacaggatctaactctctcccacttcgtcttagcttggcaatggtgactcagacaacttcatgccatgttcactggcttagtcaacaaaaaccttagaaatcctaatacagtttaagactggcactggattatccaggtgattctgaacattgatctctccaagtttctgaattaccaaagagcatttatttgcagcctggaaatctcaggctcggcgggggaaatggatacaggtagggcagacgccgtgttcttgccgtgcagctggaataacaaagcctctgaaaagttcaccacctctccacgtgtgtggtattttatgcatcaacacagtcgccttcacctgtgctgcatttcactcattacagataaagttgtatattggcccaactttacccagcacacacttattctgcgctgatgtttacacagcagttagaaattcctgggataataccttctatctcacgctgccatattaccaccttcaaccccattttacattggctctcattcaggggcctttgaaacacagtcatcaggatgctcagggagattaacggtgtggtctggtttagataaaataatccttaggaacctatgaccatcaagtgaatcacgaatattgataaaaacccacgtacacgttcctcacaaaatgttgtttcagttaagttttcttccttccgtgtccggaattggtgggttcttggtctcgctgacttcaagaatgaagcctcggacccttgcagtgagtgttacagttcctaaagacggtgtgtccagagttttttcctccagatgttcaaatgtgcctggagtttcttccttctggtgggttcgtggtctcgctgacttcaggagtaaagctgcagaccttcgccgtgagtgttacagctcataaaggccgtgtgtctggaattgttcattccttctggtgggttcatggtcttgctggcttcaggagtgtagaggcagaccttctcaatgagcgttacaggtcttaaaggtggcgcgtctggagttgtccatccctcccggtgggttcacggtctcgctggcctcaggaatgaagctgcagaccttcatggtgagcgttatagctgcgcagacccaaacaataagcaccaacaacatttagtgccaagagcaaaagaacaaagcttccacaccatggaagggaaccagggagggctactgctgctgctgctggctcgggtggcctgcttttattcccttatctgaccccactcacatcctgctgattggtccattttagagagagctgattggcccattttacagagagctgattggcccattttacagagacctgattggtccgttttgacagggtgctaattggtgcgtttataaaccttgagctagacacaagagtactgattggtgcatttacaatcctttagctagacacaaaagttcaagtccccactagattagctagacacagagcactgattggtgctttcacaaacctggagctagacacagagtgctcattggtgcatttacaaacctctagctagacacagagtactgattggtgcatttacaatcctttagctagacacaaaagttctccaagtccccactagattagctagacacagagcactgattggtgctcttacaaacctggagttagacacagagtgcctattggtgcacttacaaaccttgagctagacacaaagtgcagattggtgcatttacaaacctctagctagacacagagtgctgattgtttctttttcaatcctttacctagacagaaaagttctccaagtccccacccaacccagaagcccagctggcttcacctctcaatggcacttgctgtgggactttgtggtatctagcctgggcactctggcagcccagagggagctcgccccctgatcaagcccagcaggcaatggctggccacgacgagcgtggggcctgctgagcccttgcccacccgcaacctgcacaggcccgggagcgcctcccacccacgcctctccctccacacctccctgtgagcagagggagctggcttggctccagcctcggccagccccagagaggggcccccacagtgcagtggcaggctgaagggctcctcaagcatggccggagtggacaccgaggccgaggaggtgcggagagtaagcgagggctgctagcacgttgtcacctccctctctctctctcttcccctccctccctctccctccctccctccctccctcccttccttccttccttctttccttccttccttccttttctttcttcttcaggtggaactcgaactccagggctcaagagagcctcctacctcagcctcccaaatagccagaggctacaggattgcaccaccacaacggtattcctgaaaagcttctaaaatcttccaataaaagtggttttaggctttcatgtcttaggaggtcttctttaaatatgaaaaaaaagataaaaattagaagttaaaacatgcatagttatgtttaatgtttatgctataaaagagaaattcttatactacatatattcagtgaatttcctctaaacataaactaatattcccctgaaaacaaataaagaaattgaatgatacaactgtcttattccttaaactacaaaaataaaatgcaaagccttggtaaaaaaccaaccaaacaaacaaaaacaatcacacaccaaaaagttggactttcacatatggagtctgaagttggcttttatgacacccaagggcttattcattgtaattatttgtaatatttgtgatatatattatatatataattatttgtgaaacatagcaatgaatgttgtcattattgaagtaatattaattgctgttttaggttttattttgcatttgtttggtttataaaagcattcaaatcctaaagaaaactatactgcttaagtaattgccagctttatgcttcatgaaatcgtttttatggcattaataaatatgaaataaatatctaaaacttaaaatcttcaaatggcatagaatttctaattagtgaaatgatttctgttgttactgaatgtcttcgttggaactattctttttctgttacccaaaatttttcccttaaaagttttaagagacctaaacttaaataaactttaaaataaaacctagatagttttgcctttaagccgggcatggtggtgcactcctgtagtctcagctacttgagaagccgaggtcagaggatcacttgagcccaagagtttgagaccagtcttgttgatacagaaagatcttccttgcctcttacaaaaaaaaaaatccaaattagaaggacttatacaactttcttgtagaattcactttacgtgaacatgcagtagacattcagtacacttgtggactactcagagacaatgttgaatcagttgtgttgagattcatttattttcagatttggaaccagtccttagcccacactagaatatttaaaataatttaaaaataaataagtaattgtgaaaataaatattaaactgtcttctcagcttgaaacagatataaaatgcaaaattaatcatataaagcaatcctataaatattgctagcttgggcaatcatacaaattaagatcagttatgcattcatgatagctcactgatataataaaaatgatgtagggcatgtggttgggtgtcgttgaaatcagatttcacttgtcagtgatactgatttgaaaaaaacataaattgaagaaaccctaatcaatgggactaaataatacaatcaaattaacataaaatcttcatagaatgttttcattatcagtgaacatagtactccaggctttcaggagccatattatagagatggtagaatgtttggaaaaatattttaaagatattcaaatcacttaattataatttaagtaaattttggttcaccaagtaagaaaaactcacatttgtatttcttccccttagccacacagagctgggtagaagacggcttctcttcaaagtatcgttccttcatctagcatagttgctatggccataataagtcaaagacataggttgtggtcatcctaaaaaatgaagcctatattttgattactgtaaacagcattggaaaaaaaagtctgtgtaaggcttgaaagaatatactctttattgtttatgcatgaggcgtcctaggagaagctacatatgtagctgcttacatatgtatactttattacaaatgaagtggagtggaaaaaaacaataacagagaagactgttgtagaaaaatcctcagttatgaggctcagatgtaaatgtaaaacctaggggcttagatctttaaagcttctggctttaagaatgctagtttatgatatgtagttttaggaggagcccttgagagaaactatatttactgcaaagatttgcaaagaaaaaaaaaaaatacatgtgaagtaaaagtactatccattaaacactgaaagccaatttcaatgagaaataatttttaaagttaagttatggggcctccacagagaaataaagcataagaaggaagtgttcttgttagatttcccagggttgcttttctgggtgacaatggcctcatctgtaaaatgtaaatagccgtgaagatatttaactgaatagagattttccaagcagatatcttgaggtccctttcaatgggaaagtatgtaaaataacagggttgcagaagctagagtgaaaggagagtttggtaagaagcggatgactgagtgttatttctgattaaaaaagaaaaaggcaattaagattagaaagaaattaagaagggagcatcttcaattagctacatgaaaggagagtttatgtctatcagcctatcagaagggcttgcatccgagatacaaatgaggtttatcaaaatcaatgctactgaggaccccatcatgggtgactattaaagtgaatcacaaactcagaatggaacccaaaaaaatttcaataatgtacttctgacccattaaagtaaattcaattacagtttttaatgttgttattactgaaaagagttaagtgcacacgtatgtcagttcatatgatacaaaatagcaataatccaagtgctcagcgggggcgctgcccggtggctctggccccgccgggccgttggcccagcccgccggcccctgagctccggtagcccgccgctggagaagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaaggtttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaagtaggtggccttagacatgcatctgccagcattgggggttcagaagcctataggcacatgaaatttgaaggaggtgttcacagagtacaaagagtgccaaagacagaaaagcaaggctgcgtccatactagcaccatgactgtagcaatattaccccagcctactgagattaatctggtgattaatccgaaagatttgagaattgacactaagcgagccagtggagctggggagcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatgtagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccaattatgaatctttagtagaaattatttcccaaaaagtttaagttgatttgttatttatagactttcgtagcttagaaaaattctacagtacatccacatagggtgaaagtacccttactctcttgaaaaacgtgagttaacacagttggaggtaatatgcatattctgaagtcatagataatttacacagatctctctcaatgcattagcaaaaatcatacaatatacagatggtcctcgatttacattgtggttaattcccaataaacccgtcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactctcaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctctaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgaaggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatcagatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacaaaaaaaaaaaaaaaaaaagtgctcagcaacaaggcacccagtcatcccatatgtattcaccgggatctaggtgggtgctggtcagtcattgacctgggtaccagggttcttggcctcagggaacctacaggctagtcagagagacagataccttctttgatcagtcaaggaaatatatacttacaaactctgataattacctgatgttcagaaagacaacaaaagaatatcacttagcctaagcttcattaaagaagtaccacttgcactgaaatatagactaaacgattaggtgtaaggttcatttcatgatcaaggaccatcccatgagagaggagcaggagagcatgatctttgaagaatctgaaagaccagtgtgctgaaatacagagtgaggacagagtgctactagaccttaagaaaattatagagaaattatactgaaaatagtattaaaaatataacatagccttaaattaaaattgtatatattttattcatagtttaagttatgcatttatgtacatgaagactggaagaacatatagcaaaacaaagagttgtatgagtattgtgaaattatcaattccaccccctctcttttaaaagtatatatcttagtgaatgtgctttgttggcttttgtcctaaaactggaaagacacagaaacattgttccagtgtttaacaagattaacatgcacaagactgacatacacatttttgaagtgtttcatattttggattgatattattagaaaattaccacttgccagtcatcataatgcaaactgattccagcaaaaatcatcaaaagatgctgaaaaatcatcaaaaggtgacttagctggtgaaagtttgaggactaacaggatatttacatcatctcagagtgtctcctcataatgtgcttactagtaagaaagaactaactggtgactttgcaatgagcagacctggcaggggtccaccatcttcatgaagtgatctaagttaacatcacgagtaatgagatgaatcaatacttagtgtctcttgataagatgcactgagaagaacataatatcatagtgaataattctgagaaaataaggtatcgtctaaattctgggtcatatattgtgaagagatatcagacaaacccaaattgagagacattctacaaaatacctggtctgtactcttcaaaatgacattgtcgtgaagcacacagtaaggccgaagaatcgttccaaattataggagactatagaggaatgatggcacatgggaataaaggttctcggtagccacagctgtactggcattgtggaagtgctccatgagagattgcctaagtgtgactatcattctctggccctcacacaattctatggcagagacaatgtatctttaaaatataccattctctcatcctagacacagaagacaagatttgccagcctctattgtagttgggtagtgggcaaattctagcaaaatttaggtggaattgatatagaccagactcaggcctggaacttcagagcactgggcatggtgctcttgccccctcttggggaagcttagaggccacatactccagatggcatagctacaggtatagggtagtcacttggccctgttaaatcaatgtgagcaaaaactaactggttattgcttttagatttgggaggatggtctgttgtagcagcagctagcattgcttaccctaactaaaacatttgaatatcctttatttaatactcctctgcttgaaggaaatataacagatagtaacagctgaacttttatcctgactgatagtttcaattattcaatagatattttagtaaaattgttaggttattactggtaatagctaacaatttttgtgtcatctatgtgccaggcactatggcaaacattttacatatataacgctttttctatatttagaaaaattctgtgaagtaacattataatcctgatgctcagaaaggttgaataacttggttacggcaagccagttgtgaattcaggtctatctggtccccacattcatgccttttgtcattatacaatgaatatcttacttgtcttccaatgtatgaattatgtataacaagctcgtttgtgtgtatcccacattctacagctagtaattgcctctcaccctcccaccatcattgcccttttagcaagagctttgtgtacctcccaactaattttgagaagagctcagcctccaggagaggctgacttgaggagctcagtttttcaggcacaagcacaggtgactttcctattgcttgttctgactttggtggtttctcagcaacctggtcacacatttacacaaccaccctcccccttagttttctgataactaatttcctcagaaataagattctgtgctctaattttcacaaatttcaggtttcttttttgaatttagtaatcccgcactcttgtcctgtttgtcatgccatggagtatatctctcattgtgcctactgtgcctgccttgggggcatgtcacttcctctcctgaaccccagtcttctgcaatatgacaaaaatacctgtcgtacctgctgacaaacctccaggatctgaatcactcacctggacactgtggccaactgctgagcttgcggatatccactaattagatggtgtatgacatgatttggagcccctaataatgtttgccattaatgtgttcgtctccccaactaacacaactttataggttcatccatacatgccatgtctttaattgcaccccagtaatcactcaatctgaagttcttcttagaatacaattttgtgttttcaagtcgaatccattttgctaatgaatatttctcagaaaagatgacatttaacattttgaatattattttccattattctaaatttaaattgcagttagtcctgcccatcaaaattttgaaacaaaaaataaaaatgaagtgcctagtaacatcaagtcctatagatgtattgattgggacattaaaacttagttaatgatcaatttgaatcactaaaaaaaaccgtataataacaaattcatttcagcttacatatctacattacaaaatctccatgggctaaaataataaataatgctttcaaaatgaaaatagtatttaagaggccttacctaagtttgttttacccactatgtgggatacacttgttgaggcttagttacacctccaccctctaagctctcctttgctatccaacagtgaagctttggagcaaaaagtttctcaacagtgctgagccaacagtggttccagtggaatacagcaatgtgagttaggataaggatatgaagacagaagaggtcaccggtacctgtctgtccatgcctgacatcctatggcagatacggggttttgtctatgaccatcaagcagcctcatggaattacccatttcatgctgtagtcctagcaatttggaattttctaaaacagtctttgcatgttttcccttttccagcctttgcaagcttttctcccatgtatatattcaacagaaatgcatacagatatgcctcaaagacaagtacaaaaatgttagttacagagttatttataatagttcaaaataataatcaaaatcattaagtgtataatggataaacggtgacatactcatgcaatgaaatattataaaacagtaaaaagaatgagctgcatatccaacagttgtgtacattcctattactgtgtattaaacatttttaattcaaaatacataaaatggcttctttgatgaaatttggctatttattagcacgttgtcttgagtaaactattgtataattggactagcaattttaagtatgctcccaaagagtgggtctgttaagttctgtgtggggaggaatatttgaaagtggcaggagggagtttcacagcggccacagcataatcacaccagacagacagaagacagagcatgagagaggagtatgtagggcttacaacgggtggaagagacgctgaagtcaatgcttatgtagaaactctagagaaaaagaccccacatacacatggtgatgtgattaatgaaaagggaccagaccagtataatgcagagaggacaaataatctttcaaaacagtagcaatggatcactggatattccgatagggagaaaacgaatgtcaactcttacttcataccgtacacagatatcagttccagatggattgtagaccatctggacctattttaaagttaaaataataaaacttctagaagataacatagaataataattgtatgaccttgagatagcaaaattgtataaacatctcactaactgtgcaaacacaaaagattgaaacattgatttttgttaaagctaggaacatctttttaccataagataccttaagaggatggaaagcaatccacagagtgggaaagaagtttgtagtccatatttctaacaaagaactcatatgcgccatctataaagaactcaggcattgacttcaaaaggagataatccgttagaagaatgacaacaagacttaaatgggtgcttcacaaaagaatattctccccagtactttgggaggctgaggcgggtggatcacgaagtcaggagtttgagaccagcctggccaatatggtgaaaccccatctctactaaaaaaaaaaaaaaaaaaaaaaaacaaaaattagctgggagtggtggcacgtgtctgtagtcccagctacttgggaggctgacgcagaagagtcccatgaacccaggaggcagaccttgcagtgagccgagcttgcaccactgcactccagccttggtgacagagcgagactctgtctcagaaaaaattaaaaaaaagaatattatctaaagccagtaaaaacatgaaaagctacacaacaatatcagtaatcaaggatatgcaaattaaattcaaaatggagacatgaccagccgcaatcaaaatgcaagaagaatcagccttgtaatactaacaagtattggcaagtatttggaccaatagggagtcatccatcactggtagtggcttaagttgataaaatcagtgtgacacatgggaaaactgtcagtgtgtaccaaaactaaacatgtataccaaaactaaacatatgtaccaaaacaaacataaaggctttgatccaaaggattttctcccatgtgtatatgtaacagaaatgcatacagatatgcatcaaagacacgtataagaaagttagttgcagcattatttataatagttcaaaatcataagtaaatcaaatatcattaaatgtgtactggataaacagtgatatattcatataacaaaatattatacagcaataaaataaatgaattaggttggttcctcactgttttttccttttataaatattcattaagaattctagtatattttggtttctagattttcctatcttgtttacgctacctaaatctttgccacagtttttctagttaataacaactccaaatttgaaatatatgatgggaaaactagtgttgggaatgaaaacaactagcattaaagattaatgtaaataaatatagtttattattttgcagattttatttaaatgtatttagggggtacacgtgcaggttccttacatacacatattgcttagcagtgaagtctgggcttttagtgtgcccatcacccaaattattaacattgtacccaataggtaatttctcaacctttgccctcctccctccctcccatcttttgtgtgtccagtgtctattattccagtctctatatccatgtgcatgcattgtttacctcctgtttataagtgagaatatgcagcatttgactgtctgtttttgagttgtttcactgaagagaatggcctccagttccatccatgttgctgcatattttgaaaaatttaataactcatttggatatgctggttaatgctcacaatcattgcttatataatgaaatctataactcaacaatgtcattttaattaaaatgtactctttgttcattgatgacagtagttatcctgccagtgtatctcacaagagacccatctattcatttgttttccatatatccacaaataattatttcatgcctgcactttcagtactgggaatacagtgaaaaacaaaagagagcaccttgctcatggaatttataaattagctaagtggtctgacaataaacagtagaacaatgatactatttgagctggaactaaatgatggtcctctgtgtacatggcttggaggaagtagaaagaatagtggacagtccaaggaggagaaaaatggtgagcacattgaggaaagaaaaaaagaaacaactcagtgtaactgcaagggagaaagctaggatagcatggtgtgagatgatactaggtgggtggcgggggaatgcccataccagacctttcaagtcatggtgaaagttcggcctttattttgaatgcagtggaaaatcatttgaaagttatgttcaaagaaatgacaatatctctttttatgctttttattttgtattttaaaaaattttttattttaggtttgggggtacatacgaaggtttgttacatagataaacgtgtcatgggggtttgttgtacgtattattacatcacccaggtattaagcctagtacccaatagctatcttttctgctcttctccctcctcccaccttcccccctcaagtagacccgtgtctgttgtttccttctttgtgttcataagttcttatcacttagctcccacttttaagtgagaacatgcagtatttggtttcctgttcttgtgttagtttgctaaggatgatagcctccagctccatccgttctcacaaaagacgtgatctcgctcttttttatggttccataatattccatggtgtatatgtatcacattttctttatctagtctatctttgatgggcatttttttgattccatgtctttgctattgtgaaaagtgctgcaataaacatttgagtgcacatgtctttgtggtagaatgacttatattcctctgggtatatatccagaaatgagattgctaggttgaacagtagttatacttttagatctttgaggaatcgccatactgctttccacaatggttgaactgatttacactcccacaaacaatgtataagggttcccttttctccacaactttgccagcatctgttattttttgatgttttaataatagccattctggcttgtgtgagatggtatctcattgtggttttgatttgcatttctctaatgatcagtaatattgaattttttatatgcttagtgactacacgtatgttttcttttgagaagtgtctgttcatgccctttgcccactttttaatggggttatttgttttttcttgtaaatttgtttaagttccttatagatgctggatattagacttttatcagatgcatagttgcaataattttctccaattctgtacgttgtctgcccactctgttgatagtttcttttgctgtgcagaggctgttaagtttaattgtcaatttttgcttttggtgtgattgcctttgttacctttgtcatgaaatctttgcccattcctaagtccaggatggtattgccttccagggtttttatagtttttggttttatatttaagtctttaatccatcttaagttaatttttgtatacggtgtaaggaaggggtctagcttcagtcttcttcatatggttagccagttatcccagcaccatgtatttattagggagtcttttccctactgctcgtttttgtcagcttttttaaagatcacatggtaatagatgtgtggccttatttctggcctctctactctgttccactggactatgtgcctgtttttgtagcagtatcatgctgtgttggtcactgtagccttgtagtatagtttgaagttgggaaatgtgacttcttatgctgtgttctttttgtttagaattgccttggctacttgggctcttttttcatttcatatacattttaaaataattttttctagttctgtgaagaatgtcatttatagtttgataggaatagcattaaatcttcaaatttatttgggcagtatagccattttaataatattgattcttcctatccatgagtatgggatgtttttctattcttttgtgtcttctgtgatttctttattcttttttctttttcttttctttttttttttttgtgacagagtcttgctctgtcgccagataggagtgcagtggcatgatcttagctcgctacaacctccacctcccaggttcaagcggttctcctgcctcagcctcccaagtagctgggagtacaggcacatgccaccatgtccagctaatttttttatttttagtagagacttggtttcaccacgttggccaggatgatctcaatctcctgacctcgtgatctgcccacttcaacctctcaaagtgctgggattataggggtgaaccaccacgcttagcccttctgtgatttctttgagcagtgttttgtaatcctcattgtaggggtctttcaccttcctggatgctgtatttctaggtattttattttttgtggcaattgtgaatgggattgcctttctaatttggctctcagtttgcttgttgttggtgtataagaatgctagtcatttttgtacactgattttgtatcctgcaactttgctgaagttgtttatcagctgaaggagcttttgggcaaagactatggggttttctatatgtagaattatgtcatctgcatacagagatagtttgagttcctctattactatttggattggctttatttctttcttttgcctgactgctctgggtaggacttccaatactatgatgagcaggagtgttgagagaaggcatccttgtcttatgttggttttcaaggggaattcttccagcttttgtccattcagtataatactggctgtgggtttgtcacagattgctgttattattttgtggtatgttccttcaatacctagtttattgagagtttttaacaagaagggatgttgaattttatcaaaagcctttttctgcatcttttaagatagtcatgtggttttggtctttagttctgtttatgcaatgaatcacatttattgatttttgtacatcgaaccaaccttgcatcctggggaaaaagcttacttgatcatggttgataatccttttgatgtgctgctggatttggtttgccagtattttgttgacgatttttgcaccaatgttcatcaaagatatcggcctgaagttttctttttttgttgtgcctctgccaggttttggtatcaagatgttgctggcctcatagtatgagttggggagaaggtcctcctccttaatttttaggaatagtttcagtagaaattggtaccagctcctctttgtacatctggtagaattaggctgtgaatccatctggtctgacaatatcttatttatattttacaaaggctactctggatgttgtatgaaaaagtagactgtaggatgcaacatttgaagcaggaagatccacccgctacaatttctctgctccatgtatttctggcatctgctcaatttagatttttctcttctgccacccactgaaactgcttggtcacagtcatctgtgacttccagtttgcaaaattcaatgaccatttatcatcccaacccagctggactcttgacaacagcaatcaacttagttaatgactttctctttctagagaccaattcttcaattgattctagattatttttttctacgtatacactaatttcttaatgatctcaaaatttcagttttaaataaccatctgcatggtagttactctggatttacacctctatcctatgtttctctcattccttcaaactccaggcttaaacttccaagatccaaccaaatatctcctcttgcattttagcaggccttataggcattcaaaacttgacatgcacttgacatctacttccttccgaaatttccttctcccacagacttatgcacttcaggtgatgaactctccagttcctccatctaaaatcttaaatagctgttctttctctctcatctaccatccaatacatcaacaaatcaattatctgacaacatctttacttttgaattagtaccaccataaccaaaggcaccaccatctcacttgaattatggggacaacttccctgaaaaggcttcctacttctatcctttatccatattagtttatacttggaacaaccagaaaggttttgttaaaaggtaatttgaatcgcatcacgtctctgaaactcatctaagttgtttcatcttacttagagtacgagtcaaagtcattacattgtctttcatggccctcctcattctggcctcaccacatttctgtagccgactatcctctctctaactgatcttgctccagtccaatcagaattctttttaaacccagacagcaagtcttggtacctgttgtttcttctacttggtatgtgctttcccctcatcttttaggtctttgcacaaataatacctggtaagcgaaggactttctttgatcacactatttaaattttcccacttctgacatgtactatgcgtattctctgctatagttttctctcatgtgcattgtcactcaacagaagacatataattctgtttgtaagtttgctgtaatttatccttgttatttgcctctctcaacaagaatgggagttttaacatggagaaggaatttttctatattgtagtctctattgtatttccagcacttcgaagaatatctggaaaacaggaagttatcaaaacatatttgttgaataaatcatgggaaaatacaatttatacagcaaagaaactaatgataggatgcttggtgacaaccatggtcatgcggtcttatagaagacaaaggggttgaaacagcagtggagcaactggtttctgatattagtaatctttggttaagtaaaaggaaaggcagatctgatgccaaacgtaggtatatctgttgtttcgtgtataaagatgagaaactattattcagattgctcccatttctcagggaagcacacggcaaggttatcaactgagggaaattatttataaaaccttaaaaatcataggcatattggctgggcgcagtggctcatgcctggaatcccagcacttagggaggctgaggtgggaagatcgtgagttcaggagatcgagatcatcctggctaacacggtgaaaccccgtctcttctaaaaatacaaagaaaaaaattagcagggcgtggtggtgggtgcctgtagtcccagttactcgggaggctgaggcaggagaatggtgtgaacctgggaggcggagcttgcagtgagccgagatcgtgccactgaactccagcctgggtgacagagcaagactctgtctcaaaaaaaaaaaaaaaaaaaaaaaagaatattctctaaagccagtaaagacatggaaagctacacaacagtatcagtaatcaaagatatgcaaattaaactcaaaatggagatgtgaccagccacaatcagaatgcaagaacagtcagcctggtaatactaagttttggcaagtatttggaccaatagggagtcatacatcactggtaggggcttaagttgacaaaaccaatctcaaaaaaaaaatcatagttatataataagaaatgggaaaaatttaaatcagtggggaaaatatcttttcaaatgacaaggtaaaattatgcatgaagtagaggaaagtatttcagattgtagtgaggcaaatgtataatgcagagacattgcagagaaatttgccttgggctacctacacagaagttacagaaaagaaggaaggaaatgaaaaatttctggaacgatgtcatttaggaataatattaatttacaattacttttagtgaatggtacatgtcttagtcttcgtgggcttacatgacagaataccattgactaggtgtctaaaacaacagaattttgtttctcccagttctgggggctgggaagtcgaagatcaaggttccggctgctttggttcccagtgagggctctctttcttgcttgcagatgctgtcttcttgctgcatcctggcctttcctctgtgctttcacagaatgacagcaagagagctctataatgtcccttcttataagggcactcatcttatctcaccaggctcccactctcataatctcaactgataattacctcccaaagccctatcttcaaatatcatcccactggaagttagtgagaggtgacaatgtgctagcagccctcactcactctcagcacctcctcagccttgtcgccccctctggccgcgcttgaggagcgcttcaaccggccgctgcactgtgggagcccctttctgggctggccgacgctggagccctctccttctgcttctggggaggtgtggaagggagaggcgctggcgggaaccagggctgcacatggcgctcatgggccagcgtgagttctgggtggctgtgggctcagtaggccccacacttggagtggccggctggtgctgccagcactgggcagtgacgggcttagcaccccagccagcagctgcagagggggtgccaggtccccagcactgtcagcctgcccacgccatgtttgaattctcaccaggcctcagccgcctccccacagggcagagctcaggacctgcagcccgccatgcctgagcccccccacaatgggctcccgtgtggcccaagcctccccaatgtgtgccaccccctcctccatggcaccgggtcccatcaaccgcccaagggctgaggagtgcaggcatgtggcacgggactggcggacagctccacccacagccctggcatgggatccactaggcaaagccagctgggctcctgagtcaggtgggtacttggagaacttttatgtctagccagaggattgtatatgcaccaatcagcactctgtgtctatctagctccgggttcatggatgcaccaatcagcactctgtatctagctaatctggtggggacttggagaacttttatgtctagctaaagaattgtaaatacaccaatcagcactctgtatctagctcaaggtttgtaaacgcaccaatcagcaccctgtgtctagctcaaggtttgtaaatgcaccaatcagcaccctgtgtctagctcaaggtttgtaaatgcaccaatcagtgctccgtgtctagctaatctagcggggacttggagaacttttatgtctagctagaggattgtaaatacaccaatcagcactctgtgtctagctcagggattataaattcaccagtcagcaccctgtcaaaacggaccagtcagctctctgtaaaacagaccaatcaggtatctgtaaaatggaccaatcagctgtctgtaaaatgggccaatcagcacgatgtgggtggggtcagataagggaataaaagcaggctgcctcagccagtagctaccatcttgtggggtacttttgcacactgtggaggatttgttcttttgttctttgcaataactcttgttgttgctcactctttgggtctgcactgcctttatgagctgtaacaatcatcgtgaaggtctgcagtttcatttttgaggccagtaagaccacgaacctaccgggagaaatgaacaactccagaggggaggaacgaacaactccacccgcacccctttaagagctgtaacactcaccgccaaggtctgcagcttcactcctgaagccagtgagaccatgaatcccccagaatgaagaaactttgaagatgtccaaacactgggaggcacaaacttaggacgcaccatctgtaagaattgtaacagctgccgcgagggtccctggcttcattcttgaagtcagtgagaccgagaacccaccaattccgaacacatgaggacttcaacatatgaacctggtggcagggtggggggagggggagatggcagcgggtgcgggagaggtgaccataatggcatactatatattttcctttttttttttttgagtcttgctctgtggcctaggctggagtgcactggtgtgatcttggttcactgcaagctctgcctcctggtttcatgccattctcttgtgttagcctccctagtagctgggactacaggcatctgccaccacgcctggctaattttttgtatatgtagtagagacagggtttcaccgtgttagccaggatggtcttgatttcctctccttgtgatctgtccacctcggcctcccaaagtgctgggattacaggcgtgagctactgtgcctggcatatgttttcttaaaaatgtggggacaacttatacgcatggatatactgtaaagaggataatcaggaaataaaaagaggaaaggagaagagaaattactgttaccagaaaccctgcattgggttatttcaggtgctgaagttagcactgttttcctagaacctacaacacaagggaagacaagttgagatagaaggaggagcacaagaaggatgagaatgaggagtaagagaaggaagaagaggaggaatctatcaatttttacaaacaaaattttgatactgccattgaatttaaagaggaaagttttgaaaagcaaggacttatatttgaggtattgggaaaaataaataattttaacaagttatagactaaaaataaatggttaaaatcaacatttctcatagcaactctcactaatacttgtgtggtattactttaaatcttaattcagagtagcctctttttgttttcagcatctaagattatgtggtatattttgttttgcgatgacaatacaagatcagacctcagagagtctaaagacaatcttaaatgaattgtttatttgacagattctcacacatcattgatttcaaatggtctttagcataatttatcatcatgttgtgaaaatttaagacctaaaattgtggaatttcctggatcagtctatttatttctagaattggctacaaagcagatcaaaattaagccttcaaagaaaatataaaaacattgtcagctgggcacggtggcttacgcctgtaatcccaacactttgggaggctgaggctggcagataacttgaggtcaggagtttgagaccagcctggccaacatgatgaaaccttgtctctactaaaaatacaaaaaaattagccaggcatagtggcaggtgcctgtaattccagctactcgggaggctgaggcaggagaattgcttgaacctgggaggcagaggtttcagtgagccaagattgcaccactgcactccagcctgggcaacagagtaagactccgtctcaaacaaaaaaaccaaaaaacaaaattgtcaagcaattgagggaaatttttgcttgaaatctatgagaaaattgccctttagcctaaaattgacatatttagtcaaatttttaaaaatttagtcaaaaaagaaatgcatgacctctgtcaattttttaatggattttccattaagtgtcagctgcgaattgaataaaaatagcgactatttactgaagatctcccacttagaaaattctttctatatgtcatctcattctgtcatcacaatcacttaagaccaacatgcctttactgctaacactttacagacgaggaaaccgaggcttataatgggaagtagcttgatgagaggtacatagttaatggcaagctagatttgcagcgcagatataattttcacactataatgtagcatcgatttgtggaacataaaaaatttctaatagaattacttagtgttatacatataactgagggggtgcgttttcaaaatacaatgattttattttaatgtaattgagtatactttgtatctttgacagtaatcaatcacgtgtttcagagatttcttcattctcttcttctttatgaacaataaaacaccattaatgacatcaacaaagataattttttctggtttggtatatcgatatattgatacctctgctatattgatatactgtcatatttgtatatctgatatatttggttaatctgatacactgattaatagctgtcctaacttgttttatataggttttttttttgaaaagaggagccaaaaaacttttattttaggtgtaatatatcatttaaaagaagatctgttagaactttggtcaacttggattttcataggagcattataacacaggtttggagtattaataggaactgtacctacaatctaaatttctatatttaaataattgaaaatggaaagtaaatgctgtgaaaaatttattttgatcttatgagagtatttttctttaaaaaatatatcacattttaacttctcaaagaaactctttttagggaatattgagtcaattagctaagaaatctccccacctcgcaaagattacacatatattttataactgagtgtaaagtatgataatccccaatgagatatagaaattcagttacaagagatcagatagcctcgaagtagtgaaatcattaaatcttatggaaatgacccagaatcctaataggtcagaggagtctttttagagcttcattcttgagtgaaatattttctttagttttcaagggaatatcagttgtagtaggatattttgaaagtaaaattctggcaaaaagtaaaatctttgatagataccagttccccagtgaggtttattgtaatcataatcacagttgtgctttgttttatgaactcattctgtattactttattaagtctttagctgactgtaagagtttccttggaggtgttttctcaactattttgctaggaatttggcttcaaggtaatatttatccaacccagtcatagactgtcaagtcttctacaaggaatacaggctgctttcatattgtctaaagtctgttgataggaagttaaagtaaattttttttctacaaaagaaagtgaatagtgttgtacattctttagtcctcaggggttgatactgaaattggccaattattttatccatgtggagaaatattttaatataacccaaagattataattaagatactgtgcataaaatactttgaaataataatgttgagggtcagaatgaaatttgtattgttagtaagatttttaaatgaaatattttaaatagaaaagtggagaaaaatatgaaacatatatcacaaaatttaacaaatgtgagagccttgacatgtaagcttcagctatttttttcataaacaactcagacacagttcaaatcttttaaaaattcctctcattatatttcttctctttcacacatttgtgaaactatttttttccaattgttttaataatacattttcttatgtagctccttaggaggtttttaagttgttaaatttcattttaaattatttaatttttttgacattgacaaaattgcatatatttatgtatacaacatgatggtttgatatatgtatacattgtaaagtggctaaaaataaagataattaatatatgcattacctcacatacttttttttgtgctgcgaatacataaaatttgctgtaagcaattttaaagtatacagtacattgttatgaactatagtcattgggatgtgcagtaagtgacttcagtatattactgttatctaactgaattttgtgttctttgacaaacatctccccagtatcccctttccccagcctctggtgaccaccattctctctgcttctgtaagttcaacgtttttattccacatataagtgagatcacacagcatttgtctttatgtgcctggcgtatttcacttaatgtaatgtcttccaggttgatccatggtgttgtcaataatagggttcctcatctttttaaggctgaatagtattccattgtacccataccacattttctctttctttctttttctgatttcaatggtttgcttatttatttatttatttattttctttaacttttattttagtttcaagggtacatgtgcagatttgttacatgggtaagttgcatgtcacagaggtttggggtacctgtcactcaggtaatcaacatagtacccaataggtagcttttcaatcctcaccttcctccccacttccagccctcaatgatgccctggtgtttattgctcctttttctgtgtccatgtgtactcagtgtttagctcccacttataaatgaaaacatgcagtgtttgtttttctgctcctgtattagtttgcttaggataatggcctccagttccatccatgttgccataaaggacacagtcctgttcttttttatggctctagagtattccatggtgtatatataccacattctccttttccagtgcaatgttgatggctgtccaggttgagtctttgctactgtgaacgctgctgcagggaatgtagggatgcatgtgtctttatagtagaacaatttatattcctttgggtacatacccagtaatgggattgctgggtcaaatggtagttgttttcagttatttgagaaatctcccaatgctttcctcagtgtctgaactaatttatactcccatcagcagtgtgtatgttttctcgttactccacaaccttgccagcatctgttattttttgactttttgataatagccattctgactggtgtgagatggtatctcattgtggttttgatgtgcatttccctaatgattagtaatatttagcattttttcatatgcttgttggctgtatgtatgtcctcttttgagaattgtctgtccatgtcctttgcccactttctaacaggtttttttttttttttgcttgttgatttaagttccttatagattctggatataagacctttgtcatatgcatagtttgcgaatattttcttccattctgtagtttgtctatttactctattgatagtttcttttgctgtgcagaagctctttaattagatctcacgtgtccattttttgtcattggaattgcttttggagtcttcattatgaagtctgccaggaccattgtacagaatagtatttcttaggttttcttttagggtttttatagtattagattttacatttaagtctttaaaacaccttgagttgagttttgtatatggtgaaaagtacggacccagtttcaatcttctacatatgactgatcagttatccttgcaccatttgtttaataaggagtcctttccccattgcttgtttttgttgactttgtcaaagatcagatgatagtaagtgtgtgactttatttctgggttctctaacctgttcaattggtctatgtgacagcttttgtaccagtactatgctattttagttactatatccttgtagtatattcaggctttttggttacaaatgaattttagaatagttttttttttaattctgtgaaaaaaatgtcattggtagtttgataggaataaacaacaatgaatctgtaaattgctttgggatgtatggccgttttaacgatattgaatttttgtattcatcagcatggaatgatttttcattttttaatgtcatctctgagttccttcagcagtgttttgtaatactcaatgtagagatctttcaccttcaaggcagcctgctggaagaagcacagtttactggagccctggtgcttcctctctggccccatcactgcatttgcacaaagcccagacacttccccagcagttcccagtcagcaactgaaatagccaagggtgctactatgcaccagtctggagctgctttccagtgggccacttttgtttgggaaaccccagttgacctgggtaagactgttttagagatactctgactaagcctcttcctcactaatcattccctcccactgtcctttcacaggtgccagccctccttcttggctgtgaggttctctctgcctactcctgctccttccctctttgtctttcacaatcttctccccataaacttctcaccagtctcactctgcttggtatttgcttttcagaagaatgaacaaatatatcagctttttgcttctctataacatgatttgaaagtaaggaaaacaaacaaacatagttttcattgagatatctaatggacaaactgttattaatactataatagccaattctaatatttaagtatcttagcataattaataaagattttagaaacacgttgcttagtaaattgtaaggcgtcctagatatctgagaagtcaatatctttattttcatgaaaatgtggttatttgtaaaaacaaaaataattaggtatgcataactgaaaagtttactcttctgttgttttctattttacttatttacttatttttattggcaagttacaattgtatacatttatggggtacaatgcgaaacatatatacacatatatatgatatatacacacacacacaagcaatgtggcatgattaaattgagctaattatcattcataacttcactaacctatcatggggagacatttgaaattttatgatgagacatttgaaattttcctttagttattttgaaatatttaatacattattatttactatagtaaccttgctgtgcaataaatctcaaaatctgttactcttgtctacctataactttgtaccttttgataagcaacactccatctcctctctttccatggctggcatctagtaaccatcattctagtccctggttctatgagttcaactttattagagtccacatataagtaagatcatctagtatttgtctttctgtgcctagcttatttcatttagtacaatgttgttcaaattcatcaattttgttgcaaacaatgggacgttccgcaattttcaaggctgaataatattgctttgtgtacatataccacattttctatatccattcatccattgatggacacttaggtagtttctgtatttttttatactttaagttctggggtacatgtgtagaacgttcaggtttgttacataggtatacacgtgccatggtggtttgctgcacccatcagtctgtcatctacattaggtattgctcctaatgctatccctccccagcccctcaccccttgacaggccctggtgtgtggtgttccccttcctgtgtccatgtgttcttattgttcaattcccaattatgagtgagaatatgtggtgtttggttttctgttcttgtgttagtttgctgagaatgatggtttccagcttcatccatgtctctgcaaaggacatgaactcatccttttttatggctgcatagtattccatggtgtatatgtgccacattttctttatccagtctatcattgatggtcatttgggttggttccaagtctttgttattgtgaacagtgccacaataaacataagtgtgcatgagtctttagagtagaatgatttacaatcctttgggtatatacccagcaatgggatcgctgggtcaagtggtatttctggttctagatccttgaggaattttcacactgtcttccataatggttgaactaatttaccctccaaccgtgtaaaagtgttcctatttctcctgttgtgaatagcactgtaaagaacaagagagtgcagatagcccttggatatattaatttggggaaaaggttaacaaagcatacctcttacaaggggttaaagggtgctgtgccaggtgcctttagtctcagttacttgggatactgaggcaggaggatcctgggagcccagcttggacaacatggcaaggcatcatctctttttaaaaaagtgtgtgtgtgtctatatatatatatagacacacacacacgtgtatacacacacatatgtatacacacatacatacacatgtgtacacgtatatatacacatgtatacacacgtgtatatatacacatatgtatacacacacgtatatatacatatgtacacacacatatatacacatatatgtatacacacgtatatacacatatgtatacacacgcatatatacatatatgtacacacacatatacacatgcacacacacatatatacacatgtatacacacgtatatacacatatgtatacacacatatacacatatgtatacacacatgtatacacatatatactcatatgtatacacacatatacacatatgtatacacacatacacatatgtatacacacatatatacatgtatatgcacacatatatacatatgtatacacatatatacacatgtatatgcacacatacatacacatatgtatacacacatacacatatgtatatgcacgcacatacacatatataaacacatatttatacacacacacatatgtatatatatatatacacacaactcaatagcaagaaaaaaataaacagattaaaaaaggggccacggaccgaaacagacacttctcaaaagaagacacacaaatggccaaaaggtacatgaaaaaatgcttagtacactactcagtagggaaatgcaaattaaaaccacagtgagatatcacttcacacctgttaaagtagcttttatgaaaaagatgaaatacaacagtgatgaagaggaagctgaaaaaatagaactcttttacaccattggtgagaatgtaaattagtatgtctattacggaaaatagtctggaagttcctcaaaaactaaaaacagaacgactgtatgacccagtaatcattcctgagaatatacccaggatttaaccccttaatgtaaattacttcttctaaaaacagtttgtctctcggtaacttgaggaaatatgaagatcaaatgaaatgatgcgaagctgagatcagctgtgtggagtcaggagagtggtgtcttggcaatgacgttcctctgggctttgaaaacatgccaaatcgtccgtcaaattaaagactcagtgagggtggcaattcagaagccgccttcatggccttagaatcaccggacttcagacatcaatgtgtagtgtccaagtgctaaacttgcgcatccttacaccatgcgagtattctggcctatctgtgtgagggagacgtagaatacacagtaacaaatgagattcagataagatgttacaaaaataaaaagagaatcacctaacttagttccaggaatgcagaaaataaatgttgctatttcaggaactgttcctttttttaagaatataaatttattttataaaatggaggatggtttatttgttatacatcatgtcacactgccgttacttgttcatcctcattccttggaagtaatattatttgctccccctatacatctaaattactactacttagtagtagtcaaatattatttgctgcccttatacaactaaaatattatttgcttcccttatgcaactaaaatattatttgctcccactatacgtctaaattactactacttagacactaagcaggattggattgatggtctttgaaatggcaacctcgtgcagaattcatttggtcaagtttattgagtagggctgcaattcaggatggaaaagaaaagccatgagaaacatgtcccgcaactgacaatgctctgtcagcttctccaaatattatagcaactgaatgaaaaaatattttataaaaatagcaagttacggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtgtcgggcgcctgtagtcccagctactcgggagaccgaggcaggagaatggcgtgaaccccagagggcggagcctgcagtgagctgagatcgcgcccctgcactccagcctgggcgacagcgagactccgtctcaaaaaaaaaaaaaaaaaaaaatagcaagttactcattcatcatctaaattagatgtacagcaaaggagttcatgcaactttctgagtttatttggtaagtataaagtaattttgtatgacagacatctatttgccttgatacatcactataattatgaagttacattttaaagtatatggcagtgaattttgaaaaacacataaccattatagaacgagacttagtgaggagaagtcataggggacatttattttactgtcattgagactaatgtaaaaatggcagtaacatacagaaagaaattctgcttactctttcattactataatggataaaattttaattgcctgtttttccttgaaatgtaaatatttatgaaatgtgaaatactctgtaaagaaattttagcttaacaaatattaaaaatgaattatttatgcaagtaattttgtccttaaatatagccgaagcatttgcatagctgaaaaataagattcaaatctctatgaacagatgattttatatgtacatatgtaattaatagaaactcagaaattataacaagaccatagttcaaaaagtaaagtcatctattatgatgactgaagaataataattttggaaaacattattttatagcaaaacattattaataagattaacctaaaaaatctttctgctttcccttaggctctacattctttttaaataccattaacgtaaattcctgaaattgtaaggaacaaaatgaattttacaaaataccatttatctctctctagagtaatggtaaaagtccaaataaatgagctaataggattgtatacaatttccttctaaaaacacaaatgtagttttaaagaacttttaactatgtgttcaaactacataattcttctttattcatctacccaaagtataattatagcaagtaaacatagtgacttcaattaattatgcccaattttgaggaagaaaaaaatgtgtcttttatgaattttaaattaaactcaaatacacaaatcaatgttattttaactaaataaaaaatgaaaataaattgtaccccaaattctggtttgttaagttcaaaaaaagtaatatactgacaaaagtcataagcttaatatacactgggtgcatttaactagagtaatatttttaacaaagagagaataggttgtccataatgtttattttactgaatggtccgctaggatgatggcattataaatatgtatgtgtgtgtgtgtgacagagaaagaaagataatttttaggcaaaattcagttcaaaaattgcttgcattgaaatataaacactttacttattaaacagctcatttttctttcatttggatcgtattattttaaaattatttcaaacatagtaaaatgttcacatttaaaagcccatttcagaagaaaaacagcaggacaaatagataaatgatagatagatgatagatagatagatagatagatagatagatagatagatagacatagatcatgtcttagtttgtttgtgcattgtcatagaatagcacagacttggtaattacaaagaatagaaatgtatttatcatggttctggaggctgaaaagtccaagatccaggcaccagcatctggtgaggactttcttgctgaattcttacatgacgaaaggcaaatggacaacaaggggatgaatgctgtgtccccacatggcagaggagcagaatagttctttttttagtggaatgagtcaattcatgagggcagtgtctcatgactgaatcacctcccattaaactccatctcccaacactgttgcatggaaaacgaaatttccaacacatgaattttggggtacacattcagaccataacagatatatatatatttccatttatatatggagagagacacagagatagagagggcgggagagagagagagagactgacaaaacaaaaaatgacagtgacctgattagcaggtcagaaaaattttaaaaaggcagtcacaagatctgaaaagtcacaaatgtttggaaaaatcatagatgtttagaaaaatcaatgtttggattcacttagtatgaattcctcaatatcactaataattcagcattgtataaaaatgatgttaatataatggctctgaataacaatgtacattttgtgtaataagtttggacaatttagaaagctttcctctatcctaaatatcatattcttaactatcccaaagatgaagaatttttgaaaagtgaaggcctctcactgagtgagaaattagattgactttgagaatgctaatcaagattaaggaagatgtgcgaaggtcatggaaatgacgggctgtcacacttggccagacttgggtgcttggtgcagtggtgactttgacatgtgctgtcactgagctacccttgtatccagctctgcaactgtgttcctttctctcattaattccaggggatggggtcccctcagcattgaatacaactatttattaacatcttaaacagcgtcatggtcattccagtaatttaaactactactcaagaatttgtggctatttctgttcttttttcacctcatttgagtctcctcagtgtcacaatcagaactctttatctcttcaataactaactagttacaacaagccacaacggtccaatctaaatcatctttttttgccaaaataagcggggacatctattagctcctttgtttctttttgattttgctttttcctattgttttgttttttcttttaagatcttagcttcatcccttaagtatgtaccaccattctaaaagtcctttttataaattcttctcaaagattttggggccctcatgcagaattctttgtgccttattctccagcaatggaacttcggcatctagagatttcaaggtgagcgtattgattccctttagcacactttctataatatatgtagatttctcatgtggtgtaaagcatttaaattattttactagctacttaccattctttcctttcctcaggccttttttttttttttttaaaaaaaagaatgaattctgaggtgataggtgcagatgactttggagtagcaaaataaggctggatttatccatctaaaaaaaaaaaaagaaaaacattaggcctaacagtaaaaatttgaagttgagtaagaggataatgggattagagtgacagtcgcagaagctaaaacgtgtttacgtggaagacagaatcgagagatttaaagtcattctaaaagggtgaggatatctgtaatgaggagaaaaggccagggatgtaaccagggatgttttggtttaatgtttgatgtgcctcctgagtttcttctcaccatgaaatccttgggaaataaatgtatattcttatcaatgctgtagaagttggatttatatttcttcttttgtgaaatattctcacaattacactgtcatccctaaaaacaaggtcctagttttataatacatatctaatgcaaataaaatctcctttctttctgaggagctccatcaactactttatgggtactagattcgtttccatagagtgggtgctctgtttcacctacagattatgttatttaatggctctattggttatttctcttctaatacttcagtccaccgtctcctctacctctctattacaaaacctaggtcctgtgagtttcttttattaaacatctcttgcacaacctttcagaatccaaaacaactatcttcatttttttatcctttatatgagactgcatatagtttttcagttgccaacagtgtccattgaattacatgcacattcaacactctttctttcaataatttttcctcttttagttttcttatttcagtaggtttttggggaacaggtggtgtttggttacatgagtaagttctttagtggtgatttctgagattgtggtgtatccatcactcgaaaaatgcacactgtacccactgtgtagtcttttatccatcaccaccctctcaccttttgccccagtccccaaagttcattgtgtcattcttatgcctttgcatcctcatagcttagctcccacttatgagtgagaacataggatgttcagttttctattcctgagttactccacttagaataaaggtctccaattccatccaggttgctgtgaatatcattacttctttcctttttatggctgtctagtattccatggaatgtgtgtgtgtatgtatgtatatatacacatacacacatatgtgtgtgtatacattttctttatctactcattgatggatatttttgcaattgtgaattgtactgctataaacatgcgtgtgcaaatatctttttcatatgatttctttcctttgggtagataaccaggagtgggattgctggatcaaatggtagatctactttcagttctttaaggaatcttgacactgattttcatagtggttgtagtagtttacattccctccagcaatgtaaaaattcccttttcaccacatccacaccaacatttattatttttttatgtttaaattatggcctgtattagtctgttttcacactgctgataaagacatacccaagactaggcaatttacaaaagaaagaggttttatgggcttacagctccacgtggctagggaggcctgacaatcatggtggaaggtgaaaggcacatctcacatggtggcagacaagagaagagagcttgtgcagggaaattcctgtttttaaaaccgtcagatcttgtgaggcttcttcaatatcaggagaacagcaggggaaagatcctcccccatgattcaattacctcccactgggttcttcccatgaaatgtgggaattgtgggagttacaattcaagataagatttgggtggggacatggccaaaccaaatcatggccattcttgcaggagtgaggaggtatcacattgtagttttgatttgcatttccctgataattagtgatgtcaagcattttttcatatgtttgttggctatttgtatatctttttttgagaattgtctattcatgtccatagcttgctttttgataggattgttttttcatgctgttttgagtttcttgtatattctggatattagtcctttgtcagatgtttagattgcaatgatttcctcccactctgtgggttgtctgtttcttctgttgattatttcttttgccatgcagaagctttttagtttaattaagtcatgaaattaattagtttaattaagtcatgaaatgatcatattgccaaaagcaatatttaagacatgaaatttcatggttatgaaatttttgcctaagccaatgtctagaagggttttttctgatgttatctcctagaatttctatggttttgggtactagacttaagtctcccaccttgagttgatttttgtgtagggtgagagacgaggatctagcttcattctccatgtggctgccaattatcctggcaccatttgttaaatagggtgtcttttccccactttatgtttttgtttgctttgtcaaagtcagttgactgtaagtatttgactttacttctggcttctctattctgttcctttggtctatatgcctatttttataccagtaccatgctgttttggtgactatggccttatagtatagtttgatgtcaggtaacataatgactccaaatttgttctttttgcttagtcttgctgtgactatgcaggctcttttttggttctatatgaattttaggattttttctagttctatgaagaatgatggtggtattttgatggaaattgtattgaatttgtagattgcttttggcaatatgatcattttcacaaaattgattctactcacccatgaacatgggatgtgtttccatttgtttgtgtcatctacaatttctttcagcagtggtttgtagtttttcttgtagtggtccttcactttgtttaagtatattcctaagttttttgttgctcttgtttgtttgcttttttgcagctattgtaacaggggctgagttcctgatttgattctcagcttgttcactgttgttgtatagcagggctactgatgtgtgtacattaattttgtatcctgaaacattgttgaattcatttaccagttctaggaattttttgagtcttcagggatttctgggtatacaatcatgtcatcagcaaacagtagcagtttgacttcctctttactgatttggatgccctttatttctttctcttgtctgattgttctggttaggacttccagtactatgttgaatagaagtggtgaaagtgggcatccttgtcttgtgccagtatatcttgttcccattcagtataatgttggctgatggcttttattaacttaaggtatgtgccttctctgctcattttgctaagcattttaatcataaagggatgctggattttgtcatatgtttttttctgcatctattgagataatcatgtcatttttaacactatacatatgatgtgtcacatttattgacttgtgaatgttaaaccatccctgcatccctggactgaaatacacttgatcatgaattatgtttttgatatgctgttgaattctgttagctaggattttgttgaggatttttgcatctatgttcatcagggatattggtctgtagttttctttttttgttatgtcctttcctggttttggtattagggcgatattgccttcatagaatgatttaaggaggattccttctttctctctcttttggaatagtgtcaatatcattggtatcagttcttctttgaatgtctgatagaattcagctgtgaatccatctggtcctggacttcttttggtggcaatttttaaattaccatttcaatctcactgcttgttattggtctgtttaaagtctctatttcttcctggttgaatctaggatggttgcatatttccaagaatttatctctatcctctaggttttctagtatatgcatgtaaatgtgttcatagtagccctgaatgatcttttgtttttctgtggtattgattgtaatatttcccattctgtttctaattgagcttatttggatcctctctcttctcttcttggttaatctctctaatggattatcagttttatttatcatttcaaagaaccagttttttgtttcatttatcttttgtattttttttgtttcaaattaatttagttctgctctgatcttggttgtttctgttcttatgctgtgtttgggtttggtttgttcttgtttctctagttccttgaattgtgaccttagattgtctatatgtgctctttcagaaatttttttttttttttttttttttgagatggagtcttgctcagtcgccggtgcgatctcggcttactgcaagctcctcctcctgggttcaagtcattctcctgcctcagcctccagagtagctgggactacaggtacccgccaccacgcctggctcatttttttgtatttttagtagagacggggtttcactgtgttagtcaggctggtctccatctcccgacctcgtgatctgcccgtcttggcctcccaaagtgctgggattacaggcgtgagccaccatgcccagccagactttttgatataggcatttaatgctataaattttccttttaacatcgcttttgctgtatcccagaggttttgataggttatgtcactattatctttcagttcaaatacttttttaatttccatcttcatttcattgttgactcagtgattacccagcagcaggttatttaatttctatgtgcgtggttttggggattccttttggagtcgatttccaattttattccactgtggtctgagagagtacttgctataatttcgattttcttaaatgtgttgagactttttttgtggcctatcatatggtctaccttggagaatgttccacgtgctgatgaagagaatgtatactctgcagttattgggtagaatgttctgtaaatatttggtaagtacatttgttgtagggtatagtttaagtccattctttctttgttaactttctgtcttgatgagctgtctattgctgtcagtggagtactgaagtcccccactattccattgctctctatctcattttttaggtctagtagtaattattttacaaatttggtagctccagtgttaggtgcatatatatttagaattgtgatattttcctgtttgacaagtccttttataattgtataatgtccctctttgtcttttaaactgctgttgctttaaagtctgttttgtttgatataagaatagtactcctgctggcttttggtgtccatttgcatggaatatctttttccacctttttatcttaagtttatgtgagtccttatgtgtcaggttattctcttgaagacagccgatacttggtgagttctgccattctgtatcttttaagtggagcatttagaccatttacattcaaaattcatattgagatatgaggtattattctattcatcatgctatttgttgcctgaatactttttttatttcattgtgttatgttttacaggtcctgtgagatttatgctttaaggagattccactttggtgtattttgagggtttgtttcaagatgtagaactcctttcagcagttcttgtagtgctggcttggtagtggcgaattctctcagcatttgtttgtctgaaaaagactgcatctttccttcatttatgaagcttagtttcactggatacgcaattcttggctgataattgttttgtttaaggaggccaaagataggactccaatcccttctggcttggagggtttctactgagaaaactgctcttaatctgataggcttttctgtataggttacctgatgcttttgcctcacagctcttaaaattctttcctttgtctttaagtaacttgatgactgtgtagttaggtgttgatctttttgtgatgaattttccaggtgttctttgagcttcttgtatttgaatgtctaaatctctagcaaggccagggaacttttcctcaattatttccttgaatatgtctgtcaaactttcagatttctctttttcctcaggaacaccaattattcttaggtttggacatttaccataatcccaaactttttggcggctttattccttttttaaaattcttttttctctgtcagattggattaatttgaaagccttgtcttcaagctctgaaattctttcttctacttgtttgattctgttgctgagactttccagtgcattttgcattcctctaagtgtatcctcgattttcagaagttgtgactgttttttatttacgttattttattggagatttttccattcatatcctgtatcttttttttttttaatttctttaagttggacttcacctttctctggtgccttcttgatgggcttaataatcaaccttttgaattctttttctggtaattcagaggctttgtcttggtttggatccattgctggtgagctagtgtgatctaacagaggtgctaaagaaccttgtcttgtcatattaccagaattttttctggttccttctcatttgggtagactatgtcagagggaagatctggcactcaaaggctgctgttcagattcttttgtcccatggaggtgctcccttggtgtggtgctctcctttttcctctagggtggggattcctgagagccaaactgcagtgattcttatttcttttctggatctagcttcccagtggagctaccaggctctgggttggtagtgggtactgggggggtgtctgcaaagagttctgtgatgtgatccatcttcatgtctctcagccgtggatatcagcacctgctctggtggaggtagcagggcagtgaattggaatctgtgagggtccttagttgtagttttgtttattgtaccagttttgtgttggttggcctccagccagggggtagcactttttgttctttttttttgagacagagtctaactctgttacccaggctggagtgcagtggcgtgatctcggctcactgcaagctccgcctctcaggttcacgccagtctactgcctcagcctccagagtagctgggactacaggcgcctgccaccatgcccggctaattttttgtatttttttttttaatagcgatggcgtttcaccgccaggatggtctcgatctcctgacctcgtgatctgcctgcctcagcctcccaaagtgctgggattacaggcgtgagcccagcgccagagagtagcactttcaagagagcatcagctgctggaggatggggaggatcaggcggtgggcagggccatggagctcccaagagattatgtcctttgtcttcagctaccagggctggtaggaaaagatgatcaggtggggcagggttcagcgtgtgtctgtgctaagactgtccttaagcagggcttgctgctgctgttctgggggatggggtgtggttcccaggccaatggagttatgttcccagggagagtatggctgtttctgttgcatcacacatgtcgccagggaagtgggggaaagccggcagccccaggcctcacccagctcccacgcatccggtagcctgaagggccagtctcacttccaccatgtccccgcaacagcacggagtgtattttcaggcagccggtgagtagggctacaagcctccagctgagaaagcaaagccaactcacagttccttggctgtcccgcggagcctgcggtggcaaaccacctccttcagaagggtctgtggattctcctggcttttctggtatgttcctgtggtagttcttggagcagaagttcatgatgccagtcttcataggcggctctgtctgtctgagtgggagctgcaggttagtctgggctcctttccaccatttttttctcaataatttttcttgatccactactgtgccaggcattttgtagtgttggacgttggaagacacataatatagacatggttcctgtcgtattgcagtttatattctaccaacaagcgataaactaacaggaaaatatatgagtataaatgctacctacactacaaaggaaaagaacgatggatgtgtgagattgagagaattaaatcttagtttgggtggccagcaaaggccatcatgggaagatcacacttccttaagctcttttttcatcttttaaaatattcatactaacaatcacaatttgaaattgtacatttatttgtttatatatttattttaagaaatgtaggaaagtgcaaaaactgcaaaaatctctaaactacaatacatgttttgcaagctcagttgattacttcttaaatagtcatatcctgaattttgattatacaatttgcttctattccttttgagttcttcagaaaatatttaaagtttcctttactaaactttttgaatgaatttacatttttttttcctattaatggtagcatagcatgttttaaagttctatttttgctgggggcagagtcttacttagcttgagggttacttgagcatttttattagcagcagctttattatctatgattagatttcacctgggccaattcattactctcaccttccacacttcagagtaggtagataaacttaaaaatagtcaaaggaacaatttagggcatagtttacaaaataaatctagcctctaagtaataaccagcagaaaatgaaaaacaattttttttttattttggtgcattaaatgaaaaatacaagaaaatatgtatatattttggatagaatttgcaggttgtaaacttagcagaggccgggtgcggcggctcatgcttgtaatcccagcactttgggaggcttaggcgggcagatcacttgaggtcaggagtttgagaacagcctggccaacatggtgaaaccctgtctctactaaaaatacaaaacttagctggccatggtagcaggcacctgtaataccagctactcagaaggctaaggcaggagaatcacttgaacgcaggaggcggagcttgtggtgagctgagattgtgccattgcactccagcctgggcaacagagtgagactccatctgaaaaaaaaattaaattaaattaaataaataaacttaacagaaagttaagcaaacacaggcttcccatatgaagtaattagcattttgcaaagagggaacatggcattaataaaggatcctagacttaggatctccactactccatttaaaattggatctttttgaattcacggcaggttttccttaagaaacaatgtcatacatgatggcttagtgtactggtcaatccagggaaactgatttaatccataatatgacatttgggataatattggactagaccaacatatattgggaccatcatatatatacaatgcttattaaaaagatgtctatttaaggtaagttcctgaaaaatgaaaaataatagtatgctgagcaaacaatatgctacaacagaagttcaaaagaaaccgaacaaccgaaaccaaactgaacaaacaggtgtgaagaattcgatgggaaagaacagtgagaaatggtgcggttggtttctgactttaagtcacattgatttttttccacaagcaccatgtaagtattggaatgcctcttaaaactaagttgtgctaacttggctgggctgctttataaactctttacaaaatttgattcatgttttatttaagattacatttgggaggcaagtccctaggacttgagacaagctgcagcattcacctgcaagtgtggcttgcaaatcagcagactttggagccattggaaaaggctacttccagctacaaagtgaaaagatataagcagcgtgtgctgtagactgaggtagtatcttcgagttctgtcattggcacctatcagtggctgagatatcctgggttgaagtctgcaaggtccagcataatgtattatgcatgaaaagacatctcctgttacttcatttttgtaaaagattacctcaatactccttaagggctggatgacagtgtgtgaagtggctgaaacttacatcaaatgctttaataacaggtcagcaaaaaggccaatgggcttaacttttacattccaactggcacagctacaggagtgggctatttgccaaagacatcgaaccaagcctcggagaagtagaaacagctcaaccaggttcattcagcagagaatcgtggttaaaatatattaagcctggattcctcaaattctgttggtaaagttaatcgggatagggtaacacttggcatccttatgctatgactggatctctcatgggaatgagatcttagctttaatttttagaatttaattaaagcttcacaagtataaatataaaagtacttgttattgttgtcacctctgttctttagcgatgacaagtaacatcttatttgtgctaacatgaggaatccatatgatatagatttaaaatatatcattgtgtaagatcttattttttcaccttaacgttggcacctatgtaatttagctgaaacacttttagaattcaagtgagctatgcacacctctggggaaatcttgctggccagttttccagcgttcccatacagggatattcactctttggctgagcctttgcttaattgtattattttagatgatgggttgccttgtgagtaaatgatgaaaagatggaagctaaaatatacagtagcacacaccagccctgtggaaaataaatagctgactttaaaagaatgttgttccgaaagtcaagggcaattttaaagaagcagtgagtaggccaactcagtaacgagtcacagtggtgtactcattgctcctcagaggctcacatacgttctgggtgtgtgtgtggggcccagcctggagactgagagacaacattcttcacctagtgaggatggtctaaaaacaaatacattttaagaaactaaaacctaataatatcttggccaagttatgtattataaaaacaaagctaagaaaggtgagctaatgaatgaaaattagaaatacaagttctgcaatacccgtggcattcatgggagtgctgggttaatttatttaaaattgcacccgctggcagatgcaaaaaaaaaaaaaaaaaaaaaaaaaaacagaacattatctgtacgttatcctgtacttcttgccctcatgggtaacatttttactcatttagagatcaacccagcacttttcactgctgaccacaaattgttttacaaactttcatgttgattttaactggattgccagatttgcctcacagcttgaagcaaatcacatcccatagtatctgataagagcttgtaaaatagtggtacatgtttcatttaagggaaagaatagttgcctcagaaaccgtctggtctgttaactaggtgactggatggaattgcgagaaacacactatggacggacccttacacacagaaccgaacactggccccaatgtgttttgggaaaataatccttcaggaatgagcgtattagctccagatatcaaactttaatagtagagaaattgcatgtattattaaacaccaactttacatttgaggtctatgggatgcatatttttctttcaaaagttctacttttttcaggatggggatgaaactgtatcaccacccaaatctaggatacttttacttctacagtagtgaaaaaaaattccatatagtttttttttgcaagttgtaaaagcatacatgttcacatacacctgccccttcttctaaaatttttaaagaaaatgtttctgtcttatttacagctccctgaaaagtaatgttattaaaaataaacgtgtttatttgactggacacccgggtttaactacccatgagagaccgcagtgctgtggttcagtatcagatgtgactacccacaagaggacacagtgctgtgactcagtgtggtcaaggacaatgcctgctacgtgccttacggaattagaaaagggggcttttacttgtatttattggtctttaaaattttgttgtttatattcagtaaagcaatactgaaaaaatgtttttgccataaattaatatcattataacatcagaagagaaaaatctccaagatattttaaggagaattaaaaatagtaatatcaagtaaatcagccagtatttatacgttcacatcacactatgagaacgaaaactcactgtttcttgtgcatattcaaataaataacaatatgagtgtaaaatctttcaattcttcagtctgttgaaaagcctgtggaaaaactagaatctatattccaggtactccagagtatagtaatgaaaatacttatattaaaaacaggacggcgggcggtgtgcagtggctcacacctgtaatatcagcactttgggaggccgaggcgggcggatcacgaggtcaggatatcaagaccatcctggctaacatggtgaaaccccatctcaactaaaaatacaaaaaattagctgggcgtggtggcgggcacctttagtcccagctacttgggagtctgaggcaggagatttgcttgaacccaggaggtggagcttgcagtgagccgagatcacaccactgcactccagcctgggcgacagagtgagactctgtcaaaaaaaaaataataaaataaaaaaccagagaggatatgacattttttttttgaaaagtgagcagttagaagttacaaatttgatatgtaattatatacaaaatgcaatttatagatatattttctaggagccagttgcaccatcagtgcattagccctaagcctgtgtttcagacttgtgaattagaagcttctgactctcaagaggaggcctcaaggctgagagtgaagaggctgccagtccacgcatgacagccaggggtcagctctcagctcgaaggaaaggatcagcacaggaaatattttacagccacgaagaaccttgaccttttccactcttctctttttcctatttccccttctccagccccctcctctagctcatcccaataatagagtaaaatcaaagcatcctgaatatttactaagtgctacataccttgtgaactatttcacttgcagtatccctaatacagtttcaataaaccatgaccagtaaagtaataagcattgtttgaaagaaaaaaatagcctaatacacttcttgtcagacacacaaaaagcttttcttttgtacatgtctatggtaaattgctttgcatgacagcacataatctaaccaaagtggatgttctctgtttgatctgattgtctgaacaaaaaaaaagcaggtattctaaatttctttctttaatgaagtatactccatgagagacaatttcttattaaggcatatttggacttttatcaaacctattattgatctcttcatctttttccccctgctagtccaggaaatgggagctactgaaaccacaggatctgctcacggcttccaaacactctctgcagacaatatgaccacgtccatgtcctcctctggctcctgtgaggcccttttcatggaccccaggccctttcctgtttctcccagaggaggaagtccaaggcagggtctgcatctccctcgtctttgcaagccccacaacagctctcctggacagtgtctaaactaaaacttcttggctgtttagtctggttatacgtgttacaaattccccatttcctgtggggttcacagagagctacaaaattatagtaatacttcaatagaaatttctgactccatttttcaaatattatcaaatcttctaaggttctaagaccctttgctgtgaagataggtagagaaccactctaatacaaaacagcgtttgtttttctctctcaaagggaattgggactgtttggaaagtcatggaaatttgctatatactttaaaaatctagaatgccttcccaactggcacactcaggatatgaggaagcaatgtcactgcaaatcactcctgaactacatttaaactgagttacttggtttagcttgagttttctctccaggcccacagcatcctcagaactcttgtcatcaaggcttaggtagaaacctctcctcttcaaatcgtgccttcctttcagatctagttaattctagtcaggattctaggaaggcctccctctgaagacaatgcaaaaataaaaagagcgacagaccttcctttagttgacagctttccatcattttccgaatcaactgtgattcaaactttaaaaaaacccaagttagtgcctgatgactccctagactctgggacatctggtgctgccaaattgagattcccctgacaatttccgaggacaaagatcttcgaggagggcagctctagggagagtttagtcacctctgaagttgtgtctcacagacgcagcatccactgacccctgactttcagttcatattttagaactgttcccaggggatggagataaggcagtcatcaatcaggaaagtcaaacacatgcagatgactgagaacagctctccttgaatcccagtcatgggagttgaggaatgaccattcctctacatagttctattaaaaaaagtgaaataaaatttgttctattttgttagagttgcagaaataagacaacaaacacaacctcaattgggttaaaaaccacacagctctggcagcaatgttaacatcatttacatcaagttccttggctaaatgagcaatttccatatgtctagtttacatgagctcaattgtaagtgtggtagaattggcatcaaataaatggcatgggttcagatctggttttgattaccaagatttctagagtatgtttttgtgtttaactcttttttgtaactttgcccgtgaatgtttgtctaacttctgcctcatgagcactcagtttcaattccctacatatgtctatgctttgcaatttgtatcttgtagtccttgccggagtcccactgctcccgaacacatgccctgaggcagcgtgcctgcacaaccagcttccatctgaacgcttcagacatgcgctgcattcaggcaagagccctttggatcttcccaattagagcaaaatcgctagcatttaacttctaattttacaagtaacagtgatttgcaattagtaacagacatcaagatgacttgtgaccagcattatacatgttattaatttgcactcatctataattaattttacaatggcatttagctcaatgcttattataggaaaatctgtcgttgagaaccaggattattacctctacaaatacattattttctctgtaaaagaactctgactactttcaccagaagtacatttttaaagttagtattttgtactcgtagaactagattaaataatatctcgttgagtgaacgatattttaagattacaagctgaattgcttattatggctttctaaattcatacctgttctgcagcagaatatttaaaaatttaagtattgaaaatagtctaagcaaagaaaattgctacttgttaactttggaagacttgaagacataaaatttcaccaaatgacagatttataaaaatttctttttgggggaatgttcaagtattgtgaaactgttactgaaaacaaaacattaaagcattagcacgtgttttaaaaagcaataagacaatcacctctgtaagaaacacacagctaattattatgtgttctagagaatgctgtcacaatcagtcaacttacagaagcatgattttctttttattgaagttgtccctttgcaaagggtccctttagatattatttctgtgaataaataattcactgtcttcttcatactcaaagatatgcttttgagatatatgtatatatgactctttagtatgagcttaatttttttctccagcaatggctgtaagaatgcacagactacaagagacaatagtgagaaagctgagaaagctggtgatccacaccctttccattggaagcctacagggagctttcccctagggccccacgtggtcagccttagagcgactaacacttcctaattcaagaaaccaacccttggcccctgcacagcgagaaccaagatgaattgattaatgcacagtgaaaactataattctcacaaagacaaaatcttgtcagcaagtatgtctgtcccccatagcctggtgtttagcaaatgaaatatttgaaattcagtgaccacaacatctgctcctcaggccagtatctggatgcttattgtccatgttcaggtacatccatctcaaaggatgtagagccacacaccttctttcatcttacatcatttattttgttatttcctatacagggcagggacttttcttggacagagaagctgagaagtatcagataaagatgacctgcatgtactggaaaataatctgtggtttatatgtaggcggatggaagcaaaccagggtaatatacatttagaggcagagggctctcacaatatcctcttcaaaaaacattaggatgaaaacagttgcagaacatttctagtaaaatatatcattaaaacttaggctaacttaactctttccacctacacactttagtaatttacaaatagcgtttaagcatatatttcatttaaaatagagtccacatgattgaaatagttatgaaactctgagagactctcaatagaactcttagctgcttattactatctcctaagaaaacaatttaactaccctcttctcattaaaaagtaaataaaaatagtcttcatgatattgtaaagatctaataatgcttcctttgacttgtaggaacaaaagaagaatttgtagttcacagccacatgagatagtcaagtgttaaaagggaaaaagagctatcgaaggcaggaagcaaaatgccttcagagataaaaggttattcgtggctgagtgaaaaaaatggacaatgagcagaaaataatttatactacaaagtctttagacgtcatttacttggtaagacattatagaaatatttttggccgttttgtttgctttaaaatccacttaactacaaagtgacttcacagtttaaaaatgacataacataatctatatggtactacactgataatatcatctaatctttcattatgctgtgaccaagtcttctgttaaaagtctaattttaacctggcacagtggctcacgcctgtaatcccagcactttgggaggccaaggcgggtggatcacaaggtcaggagttcgagaccatcctggctaacatggtgaaacaccgtctctactaaaaatacaaaaattagccaggcgtgggggctggagcctgtagtccaagctattcgggaggctgaggcaggagaatggcgtgaacccaggaggcggagcttgcagtgagctgagatcgcgccactgcactccagcctgggcaacagagccagactctgtctcaaaaaaaaaaaaaaaaaaagtctaattttcttgttgtatcaacatttgatgtccaatatgatctttaagcagctataaaattatcaaaaattaatgctagaagaaatcttaacttatatctttcttgagataacagctctctacatttcagtcttttttaactgtggttttagaatttctacctctagaataagaaaatagaaaaaaattctttttttgagacggagtctcattctgtcacccaggctggagtgcagtggtgccatctcggctcactgcaagctccgcctcccaggttcacgccattcttctgcctcagcctcccgagtagctgggactacaggcgcccgccaccacgcccagctaattttttgtatttttagtagagacagggtttcaccatgttagccaggatggtctcgatctcctgacctcgtgatctcactgccttggcctcccaaagtgctgggattacaggcgtgagccactgcgctgggccagaaaaaaattcttatgccatttttaactgaatatgtccataaaatgaagtggttctaactaattagcactttttcaaacattggcaaatattatattatttattctctgaaaatacctacaagttatctccatacacctatgcatccttcttattctacagatggacggaaattttaaaattgtaaaagcacctctgcattgctatattagttccctattgctgccgtaacaaattactgtaaatgcagtttattaaaacaacacagacacattattttaccatctggaggacagaaatccaaaatgggtcttcagggctgcattccctctggaggctctaagagagagtctattgcctttccatctccagcttctagaggctcctgccttccacggctagtgaccttccatcactacagcctctgcttccgtcatcgcatctcctcctgcctccttcttttccttataggacccctgattatcttgggcccaccttgtaatgtaaagtaaactcccatcttaatatccttgacggggcgcgatgggccaggcctgcaataccagcactttgggaggctgaggcgggcggatcacaaggtcaggagatcgagagcatcctggctaacatgctgaaaccccatctctacttaaacaaaaaaaagatcctttatcactgcaaaggcttttttgctatgtaacctaacatgttcaaggatcccaggtactaggatgtggacatctttgcaggatcattattctgcctggtacagctgcctagtgttcagtgtccactaaaacactttatttctctgctaatattttgttgaggattttgtgtctttgctcaggaggaatctatattgctttgtaattttctttccttctgacatctttttctggttttgccatgaggcctaagttggtctcaaaaacaaagacagtaaatgttcttttctgtcttctgctagtgtctatataaaattgagatgatgtcttcctttaaagtttgatagaattcacacttacgtttgaagtgcttgaggaaatgtttttagttataaattcaatttccttaatttctctttttggtaatttgtgcccttgagaaacttcacgtcctctaagattcaaatttattgaaatgtagttattcgtgttgttttttaaaaattatctattggatgcatagtaatgtcccttcctccaagctaatttttgatgtctctacttagtagattatcaatttttgtcaaagaacaagcttttttgtttatattcatgtttccctgttgcttttgtccatttagtatttcattgttttcggcactataattacctacttactcttcattagttttaattttctctttttcttctaatttcttaaggtgaaatcttatatcactgattttgtgcctttcttatgtatgaatatatgcatccaaagttctaaatttccctctaacactgttttctcggcatccctcaacctttagcatgttgattcattcactgtcattgaatttaaaatattttctaattttatttgtaacttttttcatgagctcatgggttatttggaagtatatagtaaggatgttataggaaaatcagcttgagtatttctcacaaatatgaagttggtttaatattaaaaaatcagtgtaatataccattatcagtaaaataataaagcatgttaatctctacaaatgaaaagtattcacaaaattcaacatccattcatgatgaaaaattatcagaacatgaggaatagaaaggaatttgtgtaactttataaaggacctcttccaagaaactgaatctatcctcctaatggtagaagaatattttctcccctaagatgagaacaaggcaggaatgtccactattacttctttcctgtattgtactggaggtcctgccagagttagatgcactgggcaatgaagaaatacaaaaataaaggtataaatttgaaaggaagaagaaacattgttaggtgacagttatgtacatggaaaagcctgagaatctaccaaaatgctaccagaactcatatttctatgtattaccaatgaacaattggaaattacaatttaaaaataaatgccagatattttaaattttattttaagttcaagggtacatgtgcagtatgtgcaggtttgttacataggcaaatgtgtatcatggggatttgctgtgcagattatttcatcacccaggtatgaagcctggtacccgttagttatttttcctgatcctctcccacctcctaccttccaccctccaataggccccattgtgtgttgttcccctctatgtgtctgtgtgttctcgtcatttagctcccgcataagtgagaacatgctgtatggttttctgttcctgcattactttgctaaggataatggcctccagcttcatccatgtccctgcaaaggacatgatctcattcttttttatggctgcattgtattccatgctgtatatataccatattttctttatccagtctatcattgatgggcatttaggctgattccatgtctttgacattgtgaatagtgctgcagtgaacaaacatgtgcctgtgtctttataataaaatgatttctattcctttgggcacatacccaataatggggttgctgggtcaatggcataaataccattttcaattttattttattttttatgtttatattttttgagacagaatctcactctgtcacccaggctggagtgcagcagcgcactctcggctcactgcaagctccgcctcccgggttcatgccattctcctgcctcagcctcccgagcagctgggactacaggcacccgccaccacacccggctaattttttgtatttttagtagagacggggttttaccgtgtcagccaggatggtctcgatctcctgacctcgtgatccacccgccttggcctcccaaagtgatgggattacaggcgtgagccactgtgccaggccaaataccattttcaattttataaaaaaataaatatttagggatatgtctggaataaatgtgcaagatgtagcatagagatagagatgcagatcaatggtacagaatagagaatacagagggaaacctaaaaaatatggtcaattgagtttctgttgctctacatcctcgccagcatttggtgctgtcagtgttttggttgtaaccatttagatatgcaatgctattttgttttaatttgcacgcagtatccagttgcttcagcatcctttgttaaaaaggctatcattattttccctttgcattatccaggtgcctttgttgaaaatcaagtagccatgattatagtggtttatttttacactctgtattgttttcattgatctatatgtctatccttatgcaaatatcagactgctttaattaccatagctttatagtaagctttggaatcaggcagcataattcttctaattatgctttttcttgaaattgttttttgacagttctaggggatttttgtttgttcgtttgttcatttttgcttttccataaaaattttaggattggattgtcaacttctttaaaagcttggtagaattttgataggaattgcactgaatctatagattaattgctgtcttaacactattgaatcttctgggcatagatatttctgcatttgtttagaatgtaagcatgtatgtattttttctcagctctttaagtttccagtgttcagatttttacacttgttttattaaatttatttctaagtattttattattcttaaatgggattttcttaattttattatcagatgttttgttactaaaataaagaaataaattgagtttttataatcttgtaatctgtgacattgctaaaattatgcattagttctataattttataattccctaagattttctatatacaataatgttttctatgaataatgactttcatttattacttaacattatttcaaagaaacaactataatatttttaaatttctttttaaaaagtgtattcagaaatcttttacgaatagcattttacattcgccacatataaactgcatatttcctttcaacatcttaattaatatggttccattaactgaaacctggcccttaacaggttatccatagggacacgggagtacttactgtgccatccagaggttacttcctgcaggattatagaagctgttcagtttctgttaattcctgaaattcactagcctgtgtgagtctcccaagctgtcaatagtgatcatatggatgactagcaaaaccttgaacatactgtaggcaacagtagctactcaagtattagttgaatgagtttatttctgactcctcctcatcctcacatcagtttgtcttcctaaagggacattaaagaagaggcataaagttcaaacttgaaagtacaaacttgattaaggctcaagctcaaacttgattaaggctttcatctctctgcagttgggataggtagatataaaaccttttactacatcttagactcatctactgtgaattaggttcatttacatacaaacacatacacacacacacaagaaaaaactcaatgtaaacataaatgaaaattcttttaagcaccatttccaggggaaaataatgggaacaaaaaattattttcctgtaaatcctttaatcctttctttagaaaaagtcacattccttttttttctacttctgtcctaatttctgaagttcctctgagaatggattgtataatctgaaagcgttttagacacatgcattatgtctctctttttgaatgcctaagatactggaggaatttaataattaccttttatcttaaagataaaatatggcttcatttcctaaaagtcaaaggactgtcttgtggtgtccaattctgagctcagatcagtcatctcagtcagcttgagctattattactcttagtctaaaaattatttttgttcccctatatatagcccccctcacttcttccttaagagactgagaatttttcaagcccactcatatcaatgtgatatcgtagattcgattaaatgtgatgttcactgttttttgtattgaaaaggcatgactcctcatgtacaagatgattctacatttttgaattccaaaataaatttgtttcaatgttgtataagattgaagatgtccaccctgatgtttttccaaacaaactataaatggtcttaatatgactgcctattaaattatatttttaaaaagtagatcctattgttttttcatattttaaaagtcaatgttcactgattttctgataagctatacttcatatatgttcttttatataaccactgtatattcaaattggatgcttgctattagcatgaagggcctctttattaactgattttgtacattatctagtataaggaggaagccacaaagaatacatcatattttccaaatgcaggtagaatctcatatgagttttcactagaaaggaaaattaaattttctttttacagtttttggcatggtccaaatacaggatactttgtgagacaaggatctgggaagaaagaaaggaatgatgtgtttatattatgcttgtgagtaagtctaggactacagctttatcactgaactgaggtcttgttgttcaccaatcaatgtaatagaaatggcagttaagaaacagatattcatgccaaaactagaggttgcattcaagcctgcattcagagaagttaaaagttctaaaaacaaaacaaaatagaaactagagctaaattaaccttggagaattaaaagtagactaaagacagaaagaaatgaaggcagattctagaaggcatattttcggcctcaagattggcctaatatggatgaaagcctgaatgtgctttctccaaaaatagagaggaaaattcctttgtgtgtgagacctcaagtctttaaggaggtgtaggatggagttttatagactaaaattatcaagttcaaatgagcaagtgttacattttcaagaaagaaagagctggatcatgtcaagggctgaggttgggaaacacatatgaaacctggaggtcacattagttccagaggtgctgatgtgagagacaaaacatgttagtgaatgcaaatgaccagtttggattcatttattcaacttaagcagagagcagaatttcctctgggtcatagtctgctcttgaaaagtgtagaataggctcattaatctgatagtctatcctccagcaaacattactgtcaaaagggacaatattagtaaataaaggaaagcaatatctcctgtttccaaccaatgaatgatctaggtaatttcctcttatacaataaatgaaggatattaaatgtgtatatacatgtgtgtatatgtgtgtatacatgtatatatatatatgtttgaccttctccatacatttaaaaaattaaattgtagtatttattgacgctttcctgatctttgctagaaataattgctctttattatacttttgggagaatatatccatgtaacccttttttgagaattgacaatgtagaattctcacagaacaaaggatctcaccaaaaacatgttttatttcacttttagtctctgggttctggtataatatacgtgctgagttttagcacatttttagtaaatttgctttgcttaaagctattaattagaattacatatagacaattagtcatgctttacgttttacctgtagagagaactgaacactattttaaaataagaataactggagttgcaagaaacggaaacaacccacagagcactgtcatagccagttggcgcttcattacatctttccacaattacttagaattcgctggatgaaacatttgctacaaatcattgctaatgcagcatcttaaataacctcaaaatgagccggtacatttctattaaactgccttaatgaacaatttaagaagtaaaatactccactatgttataatgcatttttttctccctcttcacatgttatttatgttgttgattttttttgtagtactaattttcacaactaggagaattgctgataatagaaaaatttctccagagaattctggtcatcccaagatcccactggccagtgcaagatttttgtgggtgctttatacagtaaacttttctctccatttcaaatgtcttcagcatttttttaggaggactgctgattgtctgctcaattatagtagagatgtttaattctatttgcaatgctcagtaatttaaagaaaggtggaaaaggagtcatatgaagagccacagagctcaatgatattttaggttttgctgatgtttttacgttttctcttaaaattatgtttccaatgtaatgatctttctagttacataaaatagaagaacaaagcactctggaggaagaatggtgctaccagcatgcctccttggggttggcagcctggctaggtagttttgcagggttcttgggtagaggtaagccagttgacataaagaatccagcaaacttccaggagagccccaggcctcttgcttgcctgaagcagaaatatgacacccatactgagaaataatgggagatggccatgctccatcactgtagaatataaaggtaaagaagaccctcaaataaacctgcaatgaatgggaagagccaaggccagtaggggcttggccaaccacaagatgggtcattgtgctggtgtggaagggggtccactgtccgggagggctggttgtggtttggggacagggaagaagtgagtgtctcaggatcagggcagttgctcatgccacaactattgtggcctagctttaagatgaagaactgtgctcagctgaaagagcactttcagcagataaaaggaccaaggaccttgaattccttccccatttggtgtggtggtgtctcatttggatgaattcgtcttaccttcagccattccccgttcggtgtggtgttgtctcatttggatgaatccgtcttaccttcagtcattccccgtttggtgtggtgttgtctcatttggatgaatctgtcttaccttcagtcattccccatttggtgtggtgttgtctcatttggatgaatctatcttactttcagtcattcccttgatgctgcaattgtctgtgcataatcctctagcaggaacatcactgcagatggcttttataaaatgtcaaatagtgtctctaacttctaattttagagctcccagagagggctaagccccaaagtagctcagtctatgtctggagtcccactagggtcttgtgaaaaaagttcttacctagtatattcttacctagtatagtttgtatatgttttgcctccaaatcgcacattgaactgtgatcccctgtgttggtggtagggcctggtgggaggtgtttgggtcatggggcagattcctcagaaagggcttggtgccgtccttgtgacaatgagtgacttcttgctctatcagttttcctgacattgattgctgaaagcatcctggtgcctccctcttctctctctccctgtgtcttgcatcccctcttgctatgtgatgcctactcttcttcaccttccgtcatgattggaaacttcctgaacccctcaccagaagcacatttaacactgatgactagtaccatgcttctcaaacatttttatagtgatattttcttgacacttcttgcatcactgggcttctcaagcctttctttaaatatgagtgttggccacagctctatctttagactcctaatgttttcacttggccacaatggccaattaattgttgaagattccaaaatctatacctctagcttagtatattttgctgaaataaagactctcacacccacatgtccccgggtcatatttatgtgcacatgccacaggttgctcagatttaggacttctggcccatttttgattccgtctcttcatagtcacatccacatgtcccatcaatataaccaacttccaaaaagttctctctctccacactccccttaccttcaccactctttaaaacaatggctaaatcccactaaccaattttattacatctggtgtgacacctccccttcaccttcccagctgctgacagactgacttttctaaaacacaaatctgtatcagtcaattttcttcacaggaaactcctgccttcttgaagtcagcctaaatttgcccagacctctccactgttatctcctttcactccctccatatgtatgctttctccagctgaatggagtttcctgccactctgcaagttttggcatgatttccgcctctgtgtgttcacacagaccggtcttggtgaacacttgttcctgttctcaggtcccttcatctaacaagttctcaacttccttcaaattcagctctagtgtcaagaccacctaaagacttctctgcacgtatccacctctgtttttgcctcctgttacggtgcaccctgtaaacggcgctatcattacactatttcctccggagagtgaggctgtagtttcatgatactagttaacacatagtacttcacttacgcctcacaagtaacctaataagaagagacacttacgattatgctccttttacagatcaataacatgagagacagaaaattgaaaacaaaaaattaactaaggccacacactaaatggcctttgcacctcacagaccctgcgcccatcacagacgccgcgcccctcacagacgccgcgccgcacctcacagacgccgcgccacacctcagaccctgcgccgcacctcacagaccctgcgccctacatcacagacgccgcgccacacctcacagacgccgtgccacacctcacagaccctgcgccccacctcacagacgccgcgccacacctcacagaccccgcgccccacctcacagaccccgcgccccacctcacagacgccgcgccacacctcacagacgccgcgccacacctcacagacgccgcgccacacctcacagacgccgtgccacacctcacagaccctgcgccgcacctcacagaccctgcgccctacgtcacagacgccgcgccacacctcacagacgccgcgccacacctcacagacgccgcgccacacctcacagacgccgtgccacacctcacagaccctgcgccgcacctcacagacgccgcgccgcacctcacagacgccgcgccacacctcacagacgccgcgccacacctcacagaccctgcgccgcacctcacagaccctgcgccctacgtcacagacgccgcgtagcacctcacacaccctgcgccgcatctcacagacgccgcgccccacctcacagattcacagacgctgcaccgcactgcacagacactgcattttcatagatactgcatcgcacttcacagatgctgcattttttctacacagtgaaggtttatggcaattgtgtgtttagcaagtctattggcacagttgttttttttaaaacatgtgctcactttgtttctgtgtcgtattttggtaattctctcaatacttaaaactttttttgttatgattacatctgttatggtgatctgtgatcagcgatttttgctgtggcttttctacttgttttggggcactacgaaccatgcacatatgaaatggcaaacttcattggtaaatgctgtgtgtgttctgtgtgctccagtgaccggcattcctcggcctccctccctctccacaggcccttttattctctgacacacaatcatattaaaattaggccgattaataacctcacaatggccgctaaatgtttaaataaaaggaagagttgcacatctgattttaaaatcaaaagctagaaatgatgaagcttagtgaggaaggcatgttgaaagctgaaacagaccaaaagctgggcctcttgtaccaaattgttagccaagttgtgaatggtaaggaaaagttctttaaggaaattaaaagtgctactccaatgaactcatgaatgataagaaagcaaaacatcctggctgggcacagtggctcacgcctgtaatcccggcactttgggagactgaggcaggtggatcacctggggtcaggagttcaagaccaaccagcctggccaacatggtgaaaccccatctctactgaaaatacaaaaaatagctgggcatggtggcagacacctgtagttccaaccactggggaggctgaggcaggaaaatcccttgaaccagggaggcagaggttgcagtgagctgagatcacaccactgcattagaatctgggcaacagagtgagattccatctcaaaaaaaaaataataacagaaagcgaaacatcctattgctgatatggagaaagtctgagtgatctcagtagcagattaagccagtcacagtattgccataagacaaagcctaatccagagcaaggctctaattctcttcaattctatgacgactgagagaggtgaggaatctgcagaggcaaagttccaatgtagcagaggttggttcatggggttttaggaaataagcaaccttcacaacagaaaatgcaagttgaactggcaggtgatgatgtagaagacgcagcaagttacccagaagatttggctaagattatggtggaggatggccacactaaacaaggttttcagtgtagataactcaaacagccttctaaaacagccctctaaaacagccttctattggaagaagataccatctaggattctcagaggtagggaggaaaactcaatgcctgactcaaagctgcaaagggcaggctgactttcttgttaggagttaatacagctggcaactttaaattgaagccattgctaatttactctttcaaaaatcctaaggccctcatgaattgtgctaaattctctatggatggtccctaaatgaagcagcaaagcccaaatgacagcactcctgtttacagcatggtttattgaatattttaagtccactcttgagacctacttctcagaaaaaacatatttttcagaaaacattactactcgttgacaatgcaccaagccacccaacagccctgatggcccaatggagatgtattaggagattaatgttgttctcatgcctgctaacacaacatatattctgcagcccatggatcaaggagtaatttcaaatttcaagtcttattatttaagaaacgtatttcataaggctatagctgtcatagatagtgatttctttgatggatctgggcaaagtaaattgaaaaccttacagaaagaattcaccattctagatgccattaagaacatttgtgattcatggaatcatggaaggaggtcaaaatttcggcattaaaaggagtttagaagaagttaatttcaaccctcatggatgattttgaggggttaagacttctgtggaggaaataatacacttgtggtagaaatagcaagagaattagatttctaagtggagcctaaagatgtgactgaaatttgcaatctcatgagaaaatttgaacagataaggagttgcttcttataaatgaataaagaaagtggtttcttgagatggaatctccccctggtgaagatgctgtgaacactgttgaaatgacaacaaaagatttagaatattccacacactgatttgataaagcagtgacaaggtttgagaagattgcttcaattttgaaggaaattctacaatggggaaaatgctttcaaatagcatcgcatgctacagagaaatcattcaggaaagaagagtcacccagtatggcaaattgtattgttatcttattttaaggaattgctacagccacccccaccttcagcaaccatcaacttcatcagtcagcagccgtcaataatgaggaaagagtctccctctgccagcaaaaagattatgactctctgaaggcttaggtgatgattagcactttctagcaagaaagcatttttaaattgacatatgtactttttttagacacaatgttttgcacacttcatagactacagtataatatagatatgatatttatatgcattgaaaaaccaaaaacattgtgtgacttgctttattgtgatatttgtttactgcagtggtctggaacaagacacaatatctctgagggatgcatgtattcttccatggaaaaactccttcaggatttttggtttctggttagaaggcacataacatgtattagatgactttttctctcttttgaataggctaacagggccataatgctgtcacaataacctactcttgcagaaaatgagaattgttctaagaaagtcacttcttattttcgtgtcttaactatttcaattgagaaatgaatgaagaaagatttaggagagaaacatttttctaacattttagaagagctttggggatagtggataatgaaagaaagatttctagaacactagcagatttgaagataaaagttgctgggagatgcaaagatgataagaattttacgcaaacagcccatttaatagccatttacacgagtggtctaattctaagaagtgcatgaagaagtgcttcgatttagctcttaacgtccaagtgattatttcaggcctttaaaaaatacaaacttgggtagaaaacaacaaaacaactcataaatatgtcacctttgctaaaaatcaaattctgtttcctaaatttaaaatgtagtatgattggttactctgtaaggaagcaaacaaaaagtgccaaagaaagcagaaatcagcatgtttcctaacaacagaaatggagttatagaatcaaaaaaataagatcctgcagctcattccattttccaaatattcaatatagcttttagctaccagataaaataggagtaggagatatatgtttatatattaagtattgtcaaagaaaatatagtaattataaacatatgtaaaaatatcctttgtttatcattttagtaaaatattacattgacccaaatgtaatattgcgtgtatgcacggaagtgaattgcattttaaaaatcaacatagatttttcctactattctttaggaacttaatgacttagcttgaatgaagctctgtttacagactataatattttactcaaattaaaagacagctttttacttaaattctcttcaattaagacctattatcaagtaaatgatctttagttttattttctttccaatgcattttggttacctacatccatactcaggaaaaggcaagctttcttattttcaaaatacaaccttttgttttaaaataatttaagacctaaaataagccacacaaataatacagagttcctatgtgtcttgtacacaaattcctctggttacaatttctctcatatcaaacaaaatgacagttaatgccaggaaattaacactggtgtgtacatacaatatatgtatacacattcataagctagatgtaatatattgaagtcagacaaatatgcaatacataatggaagtcatttctggtaataaagaaaaatgtacaatctatgcatcagtgctgtaaaatacaaaaccaaatagcttgtgtagcaagagggcaagcaagaattagtctttgggcagaggcctctgagccaggttctctgggatatgtgtgtgtgtgtgtgtgtgtgtgtgtgtgtgtgtgtgtgtatatatatcttctctaaaaatacaaatatatgattatatatatatgcacacacagtgtacacacatacaagtgtatatatacacaattgtgtacacacgtgtctatatatacactatatatgtatacatatatataattgtgtgtgtatgtatatatattttatttatttatttatttatttatttatttagatggagtcttgctctgttgcacaggatggagagcaatctcagctcactgcaacctccgcctctcgggttcaagcaattctcctgcctcagcctcctgagtagctgggactacaggcgcccgccagcacgcccagctaatttttttttttttttttgagatggggtctcactctgtcaggctggagtgcagtgacgtgatcaaggctcactgcaagctccgcctcccggggtcaagtgattctcctgcctgagcctcctgagtagctgggactacaggcgccgccaccacgcccagctaatttttgtatttttagtagatacggggtttcaccatgttggccaggctggtctctgcctcagcctcccaaagtgctgggattataggtatgagccactgcgcccggccttatacattttttttcagatgtgattgtttttcccttgagataaaagttaaatggaagaataggtaacaaattacttcaattcacacgaaaataagagaaatttgatctttcttttaccatataagccccttaaccttctgctatgcaatttatttcacttacccactgcagaaacattattcttatcactattaatcacgttatttttggccataacccggacacttccttccctttcaacttcttgctgcgtgtccacaccctcttctctgtcacacttagccagcattctgtcagtacctggctcaggggcctctgccccaagactaattcctgcctgtcctcttgctactgaaactattcatttggttttgtgttttacagcactgatgcataagttgtacatttttctttattactagaaataacttctattattttttgcatgtttgtctgatttcttgcaatagattatacattgcaaaaatgtaggaaccatttcttctatctctcttgaattctcctaagtgcacaatcaattatgcatatggtgaagcctaaaagtgcttgttgaatataggctgacttttggcattggatgtaaatagggcagttatagaaagacatatttgttttgaagccatttcaagaaacatatttaatagaagtttctggaataatccacattcatttagaaaatattactctttggcatagacttgagaataaataaaaagagatcgaaagtcgagggaaaatagaattaaaatgacctggaaaattgaatctacagcttttgaccaagatgctaaagaaaattaaagtccaaaatacacgtatcttaaaaatagaagggaaagtataataatctgttggtaaaatgcaaaaacaagaataaaaaccccaaacccaaactcttggaatattcttcctgggactcctgaagactgacatgtaagaagtccaactacaagaatgccctttgatggggtcccatgtcagcgtttgggtggattgtcccacctgagccctgcctttcagccctcttgctaagtcctctgacaagcaaacagtactgtggtggaccctcccaaggaggccacacctgctgaagatcccagggcaatcctgatccacaccatgggacaaggattgctttgtcaggccttgtgcaaaatcctgctcacaatattgtgaaaataaaatgcttgtagttttaagccactaaactatgagaaatagtggatatcaatttagcataaggtagcaatggagtccttatattaataacaaaccatattaaaaagaattttatgattgttgctgcattacagtaaagactaggatatgaatatgtgtgcatatatatatgcatcatacatatgcatttttattttgcagaaaatatttaaaatagtgcataaaatcagaaacccttagttgagtgatttgctgttcactgtattaaaatcaggcagtgacagtaatagtgaaatagctgcaaacagataaaatcagtggattgaacctagaaaagaaaatcaggaaaatgttcatcaatgttgacaaataggcactgtgtgaaggggctttagactgattccctaaacgtccaccaatattgagcataatggaccatggatttttatatccatgccaaactcacacacacatttatgcttattttatgtatttatgtatttatttttgagacagggtctcactcagtcatccaggctggaatgcagtggtgcaatctcagctcactgcaactttcacctcccaggctcaaggaatcctcccatctcagcctccctagtagctgggactgcagatacacaccaacatgcccggctaatttttgtatattttgtagagatggggtttccctatgttgcccaggatggtcttgaacttctgggctcaagcaatctgcccatgtcgacctctcaaagtgttgggattacaggtgtgagccactgcacccagcctatacttattttaataggcatttttgacctttaattacacacctctcacacagagaactagaaatccactggtcctggctgttttcagtgtgttctgaaaatcttttaagaactaaggttgtcaactacatctttggtttccctggggcattagctttatctaatatatattaactttgtccaaattcaatgcttcttgtcattaccttgggaatcttatatctttattctgacggactcaccactccatgtggtcatttcttcttacttgacaaagtctttgcattcatttctcatttggcttgcaagataacaactctatttttgttagttcaaaacaataaatatcactactactatcagcattaatatttagtcatttttattttatatcatattatcaattagatacttgaatttgaatgtgacagcatggaagcgacagcaaagaccatatgttcatatagatggcaagcaaagaaccagaaagatcatgtgacttgtcatgtcaaagatcaaacaattatcatactggaaagcatattctaatgtttaatttaatttttaaaatttaaattataaagtgctttctacatttataatagtacagaaaagaatataaacaaatcaattgctgaggtatttaataggagataattgtcaatttgtttcagatctctacctttaaggaggaaaaaaagaaagagaaagaatactcatttttcggctcaatattgttttcataacacactgctgactgtctcacagcttggaattattgctgatgtttactcttgtaaaaggttaatagtaagtttacttcttaaagggctttcatctgttagcacatttgattatccccatatacttgggagacagggcatctattacaatctgtgttttataaaccaatgaggcataaaaatgttaacagatttgccaaagatgtcaaagtgattcaaagagaaccagccaacctctgactgccaacctgcatgagccctgctgcgcctggctgcgtaattcatagagtcatagcttaatatctgaatatgagaacactatcaggagaaacacgttttgaatcacagttacaactccaatttttaaagaatttaaatcaatcaataattctccatcacgataattgcaaactcatctagaaaattgtaacattctcagagtgcgaaaaactattaaatgtttatcttaaacataagtttatccctttctaaatccattcacatagtatctttatataatcattccaataatcctacaaagcaggaatttgtgagtgattcttttaccaacgagaaagtggaatagctgaaaattcacgttgatagtggcttaagtcagttgtccctggtcttggctgcacactagaattatctagggagtgtctaaaattcttaggctctgctcacattgtataccaaaaatatcagaatgtctgggagtcagttccaggcatcactgttttaaagagcctcaggtaattccggatttccagtttgagaagcattaacttaagcagctgctacactgcagttacttggtcctcctcgtctagtgtttcttcctctacagaatgaaagtgcatcacagatgatcctttatctttcctgcagatatcagctataagcaattaagaaactattttacatttaagaaactctttgcccctaatttggattattccgttcatgtgcggttagaaagagatccttatggaatgcaatcactatgacatttttgactctatgtcaaattgcaggtgagatgccaaggtagccacctaaggtgctggtctttaataacttcagttctggaaatagctcaccttgttcatggcttatgaatttatttttgttatgacaaagaacagaaacttctctctttttaacttggattttaaatcaaatgaagaaacttgggactccctctgtacttaaaagacggaaataggaaacttgtgaaccaaaataataaaccttgctttatctacaagccacacatgccaatggagtctcagatgaatcccggagatcacaatactttcagttgctgtgctatgatgtgtcctcggaggtacatcattatcacctggggcccagctggggattgcttattaacactttcctgagaaacctcagctcatgtggctgtctcattcacagatcatgaggagtgattgggaaccatgtaacctggacattgtgttcaagaaactgtatcatcatcactatcatacaaatattcacacactaggaattgcacagcccactttcagaaacagggacacaccatgctcccttaatctggaacaagaaatagcaagatctctgctctaggccttcacctcctcagagaatatgggtttagaaatgagaagctgctgaatttgaatacctttattttctactattattcagggtctctggtagtaaacaaagaagttttgaatctatactatgcataacccaatctctcaagaagcttcctagattgcagtggcttgataaggaaggtaatatgtcgtaccaacacaaataaatcatttttctctaagcaattccagaataatttgcccaattttgccacttgacatcttttggctattatatattagcaggcttcccttttctcatattgcaaatatcattaaaatcatcacgcacgtcattgaccttcttatttctacattggagaagtcatttagatataactagcactgaattaatttgctactcagactaacagtaaagttattgaaaagtgctttaaatgatttaacagtgcaaagaaatggatcccctaattttgataccacaaatcttatgtattttaatcaatctaatgttttcatgagtcaaatattcttcaataggagaaaattttaactggcattcataaataattgtatgatataatgaaactgcttccaatgtcttccctgatacaagctcacttctcaaataccagtgtgtagacaaatgttgtacataaataataattaagtttaaaataaaatcaaggttttctgcacggtatttaatgttcatatccttttctatgcaactcactttgccacctggtcctcaaatgccccatattaagtgggcacacatataatgttcagagagctttgatttttctctgttttcatagtgtttagtaaaagacaaaatatatctgatttcaaaatgctattttaggctcatgcttgtaatcccagcactttgggaggccagggtgggtggatcagttgagatcaagagtttgagatcagcctggccaacatggtgagacccctctctactaaaaattcaaaaattagccaggcatggtagtgggcacctgtattcccagctactcagaaggctgaggcaggagaattgcttgaaccaggaggcagaggttgcagtgagccaagatcgggccactgcactccagcctgggcgacagagcgagactctgtctcaaaataaataaataaataaataaataaataaaatattacattacaaggctactatactaatctgtgatatcaacattactatcctaataagctggtttataaactaattaataatttggattaagataggatcacacatctccttgcctcacattccacaatatgacaaaaaagataagtttgaatatggcaaatccagtgcagaatgggaaaacgataaatagtgtcattaaggcacagacattttatagggtctttgaaaggtagaaaatgcacagggatcaaatctaggtagaaataaaatcagaagaaatatgtatctaaaacaagtgctgaggaaagctatttttaaagctactgctggtgtgtggagaagcttaaggtctagaatcgatggctgaaagaagtgggaaggaccatgggaaatgtatcttgattaagtgggagctaaattgagaggagctaggtcatctgacttacatggaaaattattcaagtgagcactggtaaaagcattcacgctaagcagcaaatagtggtgcaattaccctctggttataacggaaatgcaggaactggagcagagatcaagacaattccccaggtaattgctggtcacagaaagggcaggatctctccggcacaggacccaagtctcatcttccagttaccagtttagacttaagtaaacataatagaaggatgtaaagaaactgtgaaacatgaatatgagtagacaaccccaaatacacaacattggaagaaaatcaacaccactggaggcgatggatactccatataccctgatgtgattattataccttatcaaaatatatcatgtacaccataaatatatatacctactatgtacccacaaaaataaaaattaaaaacaaaacaacaaaaaagcaaaccaatatcacaaaaagttgccaatctcaaggactaagaaggactaagattcagtgaaacacgtaaagtcaatagggacttgagaagaagtgtcagtaagtggtgtgtgtcttcagggatatacaacaggatacgttcctcataatgaagaagccatcacgtgatttggaaattaaaatctttattttttaaagctcaacagatgcagtaaataccagaatggacaatctggaaaagaagattagtcagccaaaatgattacatttaagaattttattaggtaaaaggtgaaagaaaagaggcacgtaagtgataaaggacataaaagctatatccagaaagctaacaatctctctaattgaactttgggaaaggaacattgaaagaatatgggggatgtgcaggaaaaataagagaaagaaatacagaatccaagtcctttgcttttttccttttagttcattctgaaaattatcttctctatattaacatcttcagcatagtttgaaaacttcaaataatatttatttatactcctgattgttctagttttataaaacagtataatgaacacagtggtaaagctgatatttagttaaatttcagcagttttatctgccttcagttgacactgttatcttggtctcaaagggctgaatgtagaataataggctgtctttagccaacacagagattttcataaatttctccaaatataatcacaaacttaagattccaggcagataaaattatgatggaaggaaaagaataactgggagtccatcaatcaaacataaccaatgtgctgagtagagaaatttacatgctacaaggagtgaagacattcatatcttaacaaacacttctctttctgcatcacgtagtctcatattttcataaaattaacaaattagcttttgcccaaggtaggcaagctttctttaagactcttgaacctgttgtaaatatttgtaaataataggtctcaatttgtttgtcctgtgtcaatgataagtaacttgttatgctttcttcttattactgaaatcatgcttaatatttgatagactctatctatggcaaatactccatatggcagcaaagatccattccttcatttgtgttgttaagactggaaatgccatttcaagtgtacgcactaaggtttatagcacaataaagatttattaaaaccactccacagagccacgttgtacagaatttatgaactgtaaaactgctataaaggtcacttgagatgcaaaagtttaatttggaatatcatgttatggtacagaattgctgcattcaatgcttgttaatataaatggtttaaagatatttgtctcagtctgtgaagtttatgaacttcaacaaaaataatttcatattttataatattttacatagatttgatttctttaaagtttttctacaaatccataactcatctcatctgtaaaatagtgaggaaaatagatacaaattggatcttactttcaaaattcactgttgtttcatagagcatattccttatcattacttaaccaacttctgacatttaccatttcataccattattcattcattgcttttctgataccaagagcctaaggaatggatagcttttcaagagatatcacaaaaatgaacaagatattgagcatttataacaggaacattggggaaggcattgctaaaagagattatgaattataatagtgtctgaatgtgtgatattatatttgtatatagacagatacatataaagttacatcaactcaagtgaatacaatctaagaaaagattaattatagacaattataattctgtagtaggatgaatatcatacaataaaagtgtaataagatgcaaagacaacataaacaatagggagcattttcaaagtacatcttccagcaatttttttgttgtaaaacagtataaactgatttttctatgttttgttatgcataagaaccaatacttttttatcaaagatcaagaatgtagaagcagaatattatggaatgtatgtgaaacttctgaatagcaccagaacacggcatagccattcccatggcatttacgttgtaaatgttaaactataaaatattgtgctcatctctctatcaactaaaacatttgaaaatcatggtttcttttaatgttaaccacaaaaggatcatggtatcatgtaattctattcctccacttttttatataaggatggtagagatgtccccaaaatgtacaggactagaactttctgcccaccatgaaaaaggtatagctaacatgctctgcatacttacgatttactgagcattttattaaataattctttggaatttttctctttcaacaacactttgtcagagatgatattattattcatatcttcaagatgagaaaaactgaatcttgggggtttaagtaatctgcataaggtgacacaggcacacaatagtggagctgacactcaaacccttgaatgaaccacaaagcttatgttcttaataatccattatcctctattttactgctttcatgctaggaccaattagagcagcccatgaggataggcaaaacaatcacaggttattatggaaaatataaacatttcaaccggagaattttctgttcccaaatattccagacatgtgtctacctgaagttgtagatcatgtacaaaagaatgacagagttcagttcattcctccagttctagtgttcactgcacatagtctccctctcacacagcccagtgcacacaaacagtgtcttcatgctttagtagatctctctttctttggtttcctattccaggatcatgtttctccatcaaacacaaccaacccaacaaacaatacttacctttctgtttggagaaacccagaatatacatattatataattatattaatatatatataataatattatataattaataatattatataattaataatatatattataattaataatatatattataattaataatatataattaataatatatattataattaataatatatataatattatataatatataatatatataatataattatatataatgtatattctgagtgtgtatacatatatgtgtgtgtatgtgtagatagataattatataattatattatatatattattatataatataattatataatatttaatatatataatatataatatatataaaatattatatattatatgtataatatattatataatatattatacatataatatgtatattctgagtgtgtatacatatatgtgtgtgtgtgtatgtgtagatagatagatacactaagaggtctatgattcatgtcacaaacccatcagggtcatatgttgcttctagagaatgtgctgtacactacatcattatgggtctcaatttatccctacctataccccacattaccactctctttgaaatctgatcccatctaatattagtactcatttctggaagatattttttgctcctctttgaactgtaaaatttcattaaatttttctcgctaaagtgtaaaacaatatccatagacatttgtaaatggagtacatttttgtgccctctttgtatgctcattttcactgaccttgcctgcagtatagagctgtataatgatacaccaaaatgagtgaagataagacagataaattaggaagattaagattatctgagacagatcatctctgtaatttaaatgatgagctttaaaaaactctagacagagggtagaattgttagcagttagtacacttgctctgattcaaggaaataagtttaactcaaatattcataaatcagagtggagttaaagggttgtggcataaaagcagggtgacataggagaactaacccaatcacggccacgagaagaagttcttctctagcttctaccaagtaatacttcatcctcatcctagacagacgggtatccaggctatgctagctgtattgcttttatcatatacaattagtagtgtgtatagaactttacttatgacatactgtaaaggtaactatacttatcctctaattataaatacatttattttcaactagtctttaagttatatttttaaggtttggatttaaaagtaaaactttaaagtgtattacagtgaggcaccaaatttccaggagctaattaatgattttgaaatgtgcctggtgttggctgagtcgacagcaacactctatggatgggtggtttgtggaggaattctgacttgagagtacaatagcactcagcaataaatcatattagtttcagtcaactctagaggcagaacagacctaagaacatacacagcatagcagctcctgggtgctgctggaggccctcatgacagagacagaccagtgggattgtttcaagcaaattctaatctgtttctatatcctgtctgtatgtctgtataaataagatatagatatgtcactatcaaatatatttctcaacacaaatttcatgctttcttctgtttttaaaacagagctgttgtaactatttaatttacataactttaaagcttctatgaagctattattgtgactgaatacacaggcaaaagacatagttggctcaaaagaatcaaaatccaatggaaaagagtgtttcttagactattcgttttagatgagagtcttaattcataattttactgcagaaataatttggtaggtttaagaaaaatgatactaaaggttactttctatcaagaactatacaaagcataaaaattatatttgttgacctgaaatcacagaaagattaacaacctaaaatttcatatataataccataatgtctgcgcaatcctgcaaacagctctttcctcctacctgagagcaacttgccatactgagtgtccaatacattttttcaagtggtaaatttatttgtgtgtgtgtgcgtatgtacacaggtgtgtttatatagtttagaaataaagtttgcctatatggtaaacaatttctgctaagccatatagctatgacctatattcatattttaaaaaaaacccttaggaaaatagaatacacaatttgaacttagagtgtttatagtttctcatactttcaaaattctcagcatggcttataggacattgcagatttggtttctgtcttcttttccaaccacatctcctaaaactcattgtcctccacccttcatgcattctatacagctaagttacttttcaattccttgaaaagtgccaaacactttcctgccttaactgtagcacacatagtattgtttgtgctctgagtaattttcaaatatttataatattcagaatattatatatataataaacaagtttgctaatacgtgagggaataggacaatgtaaaggatgaccaaaatgatttataaaataatcaacataaccattagaagttaaatatacaatcaaaattttaaaataagaggaaagatttaatagcagatatgacatagttcaagagaaacttagtgaagtggaataagatatacagaaattattcagaatgcagtgaagaaaaacgaaaagatgaaatgtaaaagagagcttaagaaacatggaagaatgtgtgagaagacctaacatacatataattggtgatcctgttggagaagaaaaaggaagagagaaagaatggggctgaggatatctttgaaattatagggactaaaaattttcagaagaaataaaaaaacacaaagtttaaacagctccaatatgtacccagaaagagtttaaaatatcaacacaaaaagagatcataatgaaggagtaaacagagaaagaaaatatattaaaattagccagaattagaagattgtttccattcaaaggagcaagagttaaactagaagctggcattttagcagaagtaacagaagtctgagagataccttcattgcattgcagagaataaccatttacccagagcctttaccaggaaccaagtgtctctcaagaatgaagtcaaaataaagacatttgtcgggaaaacaaactgataaaacttatcaactgcaaactttttctaaagaatattttaaaaaatgtacttcaggcacaaggaaagtaaatccataaggaaaatctaacaagaaaaaatgaaaagcaaagaaattaatagatatattttaaaaattagattataaacgatacaaactacaacaataacattttgggagattagaaaaatggaattaaagtatgtgtcaacaatagcacattcattgagaaaaggttgaatgagttaaatgctctctatagttcaaaacaatagaacaaatgttcattaaatttagattttgtaaagtgaacaacctacaatcatcagtataacactaaaagtctgaaaaatggaacaattaacttctaaacttatagagggaaaaaatgaaatgagaaataaaaatacccaattgtaattgcaatattaaaataaaacacttatttttgtaataggcactgctataagagctttatctacattaacaaatgcaagcctccactgtcacagttttaaaaatatataaggaatattaaaaagaaaggcaagatagaaaaaaacaaagcaacgataagtatgaaaaatagaaattaaaagatagtgaatagaaattcaaatatatctggagcaacaaaactgtaaatgcactaaatgattcaactaaaaaactaagattgtcagactatactaaagcacaaacaagaaactgtgtaatgcaaaattgtacattttacctgagacatcttaaattaaaagatacagaagggattttacaaaaatagaaaaatttatactagtaacatttttactaaaacagaagtggcagaaatacattatcaggtaatatagactttaagaaaaaggcttgacaaaaataaatatgaccatttcacaatcccaacatttaatgtgccagtaaggtgtatcaatttaatgtggagcacttaaaaacaaagctacaaatgtgaaaaattgaaaactaagagcagaattagtatgatgtacagcaggaaaaatttgagtaaaatttttgagtgttacataaaatagccaaaaatcactaagaatataaaaattcactaagactgtagaaagtttgataaacaagaccaaaaaacttgactcaatatgtataaaatattgtgcaaaataactaaagaatacacatcctttaagcccatggggaacatataaaatttgactgtggtgaaccataaaggaagcctcaatgatttcagtatttgaaatcctgcagctcctattaagctcaaatcaataacaaaaagatcacttaaaaaatctgcgtctgtctggaagttcagaagcatacttttacgtcacccagacagttttttaaaaattatcattgaaattagattacatttgaattaagtaataattaaaatataatttgatgctattaaattacaataatcctgcatatgtaatcttatagatgtggctaatgtaattcacaaaggaaaatgttaagccgttagtgctaatattagatccccataatatactatatgtcaaacaggctctcctggagctgcctacatttttttcaacccctaaaatcacaaaagtagttcctagaaagtcataaaagtgaccttaacatgctagcaatgacaattccatttatggattggatattatgtgccattcaacaagtgtgggggagattgctgtttgttctactaaatgtctgttcttccctcttgtcttattaataggactctaactctctctctttttttttttagcaataggttttcagtataaagactctattttccaccatcccttgccatatgtttggaccctgtacttaagttgaggccaatgggttgtgaaagtattgagaaggagcttgtggaaagccttaaaaaagaaatctcagctggtgtgcaccctctgcatgtctaagtaattctgatttaactgctggagctgctgtcttgacccatggccatgaaagttatttctagggacagcagagtgctgatctggaaggaacctggggcctagcaactttgaagccagcatgccctgtacgcttacatctgtactttgtataagagggaaataggcttctgtcataattaaacaggtatttttggttttctgtaaatgtagtcaaatctaatggatatattatgctctgtgcttcacatattttatttagtctttatgcatgctcatgaggtaggaattactatgcctattatgtttattttacaaattaggaaatagatatttcaattttcattttaatttcctggagttagtaagcagaagagctgagttttgaatctaggtcagtctggctcctgccttatgttttcatgggctaatctgtgaggttttatataatcatgcattctggggaccttatcagtgcctgaaacactgcctagctctctgtatactaccttatatgcagtggattttagtaggtatttgttattcaagtcatctaccgccatgggttgacaaggcttaggcagagggaaaggggtatctgtggggaaagggagtgtggagtaggcagatatcactgcctctcctctcacgatgaaagggctccctaaacatgtgatgtcaattcacttaggtacaaaatcatggcaaaattacaacaatagtggttggatgaaaagaaggataaagaaatgacaacacaataaaggaaaaaatgccctgaaaaatgaattaaaactgccaagttcttcttgtacccatagaatatttgtctttttaagaaaattttaactcttggctgattttcaacttccaaaaaattagatcttttttttaagtactttgttgtgtacttaaaactttaaaaataatattgcagataaacatatctgtgtaatctctacctctagtcaaaggagtaaaaagctagaagaaaaaaaaaataacccacacaatgagaatgtgagaagtgacaatagcaaagtaattatttcagtgaaactgcagaagatggaaaacaggaataaaaatgttttctcacttaccagaagagaggaactttcaactcttggaaggagggtgctgacaatgcccaagcctccattctggagaagccatgggatctcaggtttctagcatcggggcactgcaaatagagactcagaagcaaaggaagctagaggaaaggcaaaaaaaaaaaaaaaaaagtcatcgaaacagaaagaattgcaaaacagagaaaaaggacagagagcaagaaaatgctttaaaataaaatatgaacaatttgtactttattttttttttaaattaattaactttttttgaaatggagtctccctctgtcaccaggctggagtgcagtggtgcaatcttggctccctgaaacctccgcctcccgggttcaagccagtctcctgcctcagcctcccgagtagctgggactacaggtgcctgccaccacgcccggataatttttgtattttcagtggagacagagtttcaccgtgttagccaggatggtctccaacccctgacctcgtgatccgcctgcctcggccttccaaagtgctgagattacaggtgtgagccactgcgcccggccaatttgtacttaaaaaagtcaatatccgtgagacatagtgcctgtccattatgttcttcagagaaaaatagaagaactgaaatatagaaattattcagaaaaacacacaaatttcccattacctaaaaatctccagactgaaaggacgcagaatgcccaggacaataaaacaacgaagactgtctcaggaacacatcctgggatttcaaaacactagtgatgaatttaaatcctctaagtttgcaagcactggcagtgttgggggcagggcgcattgcagaacaatggcgtgcagaatgacgtcagaatctgcgccaccataactggattccaaaatggtggagccaagccttcaatccctaaggaaaagtacttttaatccagaattccacatgcatccataccatcatttaagtgtaatgagagagtagaagtattttcaaatatcctagggttaaaatgcatacaactcttatgttattatagactatgctttagaacaattattaaggcaagtagactttgggaaagagaatatccaacagagaaaccggcccaatattagaatagattagtatagatgggaacagtgggtacaagagggaggtctccaggaaatgaaaaattcatgaacagattagtgatatgaaaaaaattgagagtagcttgatgatgacttatgaggtgaatagtgataagtatgtagaaaacgaagtggatggaaaaacattaaacaatttaataaagtgaaaagtaaaatgatggtctataaaataatatttatggtttatattaatgaaaacactgtttcttgcttaaaccaaaatgttatgattttataatattgagctgtgtgaagaagttgtgggatggcatcaacaattttcaaaaaaaaagtgaatagatgatgtttaaattgatcatttgttccacaggcacatgattttaaaatatggagtcaccacaccttgaatattcaaaactttttaaattgctttgtaaaaaatgtgcaagacttactgtactacagttcagcatggtaaatggttttgcaaaaagcaatcaattctgattaattttctcatttgcatgagtgccaatgcattttctttctccctgtgaatcaccactcagtgataccattgactctcagagaaaaccacttaatgaaatttttcatcgagtcaattctttgctaataatgaaagaacatattgtcatgagccaggcatgcatgctttgccaaaatacttccctccatcatataggccttagttatccaggacacaaaaatgaattcctagtagagtctaataatttcattctactgattcattcctactgtcagtaaccaaagacagttttacaaaaacaacagttacccactgagaaggcgtaatacatagctctttttcccaagagtttgctaatgaatgcaactgtgatatgattttacttaattatgataatttagacatgacccataagaaaactactgatttaaggaaagcattaatttagtaatatataaaaatgtatgttgatgagaataagctttatatgtaacacacctaaccagaaaggaaatttttctaacattatcatttgatatgtttgtcagtatttttcctatgttgaaagatcagaattcgaagaaatgtaactgagaaattacacttccttgagtatttatttcagtgccgagataatttaattttcagtttctactacaagtggtagtaaaaagaaaattttatacattttcctataaacatttcctatattattttctatcatttagtttaaaatgatgcaatcagaaaaggaagtgctcctctaattgcctcttactattttttggagccaaattttaaggaaacatttttgtttatatctcatcttgacttcattttatttttatttaaatacattcatggtgtatttcttccattgcacagagcatggatgtctccttttagaagctttatttcagatgggtaaaatctactttataaaaggtaaggtcacacagctatgtggctggaaagaaatggataggtacatgttgctgggaggtacgtgaaagaaggacgaaagaattgccaattactttattcttcatttaagttattttataacaatgatatggttttgccttgttttaggcattggttagggttcttccccttgaaagcgatgacctatactggcaatgaaaataaattgttaaaatctgacatatttgagaagtactgatagacctttatttattaatgcccactagtgacttataacaaatgtgaaattgcatatttaaagaaataaacatcatatatgtaaaatgagagctattatgtgctgtctgggttccatagctaacattctttagtctttgtcttagaatagaagaaagaaatggaattctagagcacacaactagtttagaggggtattagtgaattaaaagaaatcactcacaaaagtatatccgatgtgtttggagtctttcattctttccaggttcggatcaactataaagcttgtgatcaactctttcccttagctgagtcttccttactgtgatctcttcccaaggaggtatactaagaattattttagtggctcttgaagggtagggtagtgggaatggttagaccaaatctggccagtaaggggtgaattgtctgaaggtaatttaaaatgagtaacacctgctaagtgccagccagcttctttgtatcatcatgcattggcaatgctcaacaatgccggtgataacgcactcctccctccaaggcagatgctcctcactgccctgctcttgtacagccaagtgacaaataattggaaaaaaaatactagagctgaactatctacatggattttaatatcagactccttttcaagttacataaaagcctgcctctagattctcacttattagacactcaacaaaaatatgatggactactatgcctggtattgtcctcaataccgcagacacaaacataaaccaaagctcctggtcttatttatttgtataagacagagggagacaaaaaagaagtaaacaagtaaatacgtagtgttggaagatcatgtttaactgaagaaaaacaaagtagggtaatggcatagaaaatactataataataatgtgtatgaagcgatttctgaagaaattgacaatgatagacaattgatagacaatgatcataaaagatctgggaccacagataacaggacatttaagcaaagacctgaaagaaatgcaggatcgtgtggctgattgatatcgggcgaaagggattttcaggcagagggaagagcaagagcacggtgttgacatgtgagcattccaggtgtgtttcagggagaggaaggagaactgtgtgccaagctgagccagcaagtgaaggaactgggggaccaggacacagaatcggcagcagggtggtcagccaggcttcatgtcatgtttatcactctagatggcatcagaagccattgaaaggttttgaggaaaggagtgaaatcatgtgccttctgttttataaaggtcagttgtatatatgttttgtaggttttacgagaattctggctagtgtgtcgagtataaactttaagaggcgagggtaaaaggccataggaaactattgtttggagctcggctgcctgttttgagaacccctagtcacatgtcactcttgaacacgtaaaacgtcacgtgtctgaattgagatgggctctaggtgtgaaattcacaacagatttccaagacttaatatgaaaaggaagtaaaagacctcaataatttttaaaatttagtaaatgatgaaataacattttgaatactctgagttaaaatacattattaaaagtaacttggcctgttccttttttctttttaatgtggctacctgaaaattgtatgctacacacctggcttgcattatatttccagagagaagagaccagactctggatatatttagaatgaacagccaagagaatgaattaaaataaagtttgaaagcatagagtcaaggatgaatacaaggttttttgtctgagcaacttggaagctaaagttgacattttaagatcaagatgagaagattaaaggaccagatataggaagaaaaatcagaagttaagttttgaacatgtgaagtcaaaaacttttatgaaatctgaaaagacagggctgtattttatgctcatctcattatcacacttggcctccacttttacatcagagaaacttcacatcccctcacagtctccccaggtatttttgtctgctcttgctttgttgtaaaggtggcatgttactctctcaactgcaaatgccatccctctactctgagccctcacggccgagggggtcacagtctgtggaacagtgagacaacagggtggcattatgtgtgtcagagcctcacaacggtttctataaaacccttctgtaggatacagtccacagttttctattactggagctcaaaggtgatctattaggacaggcagggcaacagtgtgctatgttattgtatgtgaaggtgagtccggtgaagccacagtagaggacatcagaaaggtgcaaggaaacccagattatcacacacacaagccctaaggtcaggaggcaccacaggccacctggctctggatgagtaaaggcaaaggaatgcggcctcctggggtggaagggcacagaggcagggctctggatggatcagtgtgcacaggaaaggcacactccactctgagtgctgggacatctctgcaattgcctagccctggaaggggcatcactcccaggccagtgatgtgaaaagatgtgaaaaacatcataatatacagaaaataaaaatatatgcaaaacacagatctattaccatcttgatgtttactttaggcatgcccaagtgtccatgaacagaattataactgttcttccagtctcacctgcaaagaccaagtatatcaaaaaacgcacacacgtacacacacaaatacacagacaaggaagtacacacacagaaagaattacaaggacaagaagctacacaaaagaaagcacacataaaaggaagcagattacaaaaagcacacacagggatgcacacacacacggaagcacagacagaaaaggacacacaaagggacgcacacacagggacgcacacacagggacgcacacaaacagggatgcccacacagggacacacgcaaacgggcacacacacagggacgcaaacagggatgcacacacagggacgcacacacagggaagcacacacagggacgcacacacaggaaagcacagacagaaaaggacacaccctgggacacacacacacggatgcgcacacagggacacacacatagggaagcacaaacaggaggcacacacacaggaaagcacagacagaaaaggacacacaaggacgcacacacagggacacaaacggggatgcacacacagacacacacacagggatgcacacacaggaggcacacacacaggaaagcacagacagaaaaggacacacacaaggacgcacacacaggaatgcacacacagggacgcacacaaaacaaggaaacagacacagggatgcacacatagggaaacccaaaaggcagcatacacagggacacacacacaggggagcacacacacagggacacatacacgggagcacacacacagggacacacacacagggaagcgcgcacacagggacgcacacacacagggaagcagacagagggaagcacacagaggaatgcacatacagggacgtacacacagcaaataacacacagaaggacgcacacacacacggacacacacacaagaagcacagacagggacgcacacacatagggaagcagttccacagtgaagcatacacagggaagcacacacacagggaagcacacacacagggagtcacacacacagggaagcagacacacagggatgcacacacacagggaagtacacacagggaagcagtcccacagtgaagcacacacagggaggcgaacacacaaagggaagcacacagggatgcacacagggacgcacacacagagggatgcacacacacagggaagcgcacacagggaagcacacagggaggcacacacacagggaagcagacacacagggaagcacgcataggcacacacacagggaagcagacacacagggatgcacacacacagggaagcagtcccacagtgaagcacacacagggaggcacacagggacacacaaagggaagcacacacacagggacacacaaagggaagcacacacacagggacacacaaagggaagcacacacagggacacacgcagagggaagcacacacacagggacacacacggacgcacagacacgggcgcgcacacacagggacgcacacacagggacacacaaagggaagcacacacagggacacacacgcatagggaagcacacacacagggacacacacagggacgcacagacacaggggcgcgcacacacagggacgcacacacgggcgcgcacacacagggaagcacacacacggggagcacacacacagggacacacacacacacagggaagcagtcacacagggaaacactcccacagtgaagcacacacagggacgcacatacagtaatgggcacattgtatgggtcccaagctcttcagcaaagcccagactttaaacagtaataaaaagctccactgaaatccttcgttgcatttggttgaaagtttttttgtatatttcctcatcctcctctgctggtggttttgtcttcagcagaggtgttccctcctgtattctatgctccaatgccacagaagatgaaacctacatcaaatgaccctgattccgtaaagtaagcgtgaggctgagaatctgtaaagctatttccaatgcttcaaatgatgcgaatatgtaacctcctttcaaaagatatatagataaccctccatttggatttttgatacattatcttaatttccatttttgttaagagcagcaaaaagtatttgcgactatcaagaatggtttacatcacaagactttagtaactaaaatatatgagctatatttccatttatgtgtctcagactttaaatgtggcaaaatgtgttgtaattgaagctccgattttgcctccttgtcaaccgtgatttaacagtaaggggcctgctagctgtgggttagcatggaaattaactcaccttgcaggcactttccagtgaaaagaattacaacgcaagtagtagactgaatatttagttcattaggagcaatactgtttgaaattcctattctttagttttcatgatgacatgacttatttaaaatatggtttaagaaaaagtgacaaaaatattttaattttttcagttcacttaattcatgttaatcttatagcaaacaaaccacttgattcctggagcaattatttgctcattgcaaatatttgagtagatgttagattatagttcacatttcagttttttagtttaatagacttttttagaagagttttaggtttacagcaacattgagaggaaagtagagagatttcctgtataccccctgccaccagacatgcatagaccctccctttatccacgtccccccaccagaatggtacagttgttacaattgatgaacctactttgacacgtaattttcactcaaagaccatagtttacattaggtttcgttgttggtgttggactttctataggtttggaaaaatgtgtaaagacttgtttccacccttagaatatcaaacaaagcacaggcatacctcattttatggcacttcactttactgtatttctcagacatgacactgttttatgtgttgaaggtttgtggcgataccacgttgagaaagtcaaaggtgtccttttcccacagcatgtgctcactttgtgtctctgttttgtattttggtaattttcacaacatttcaaacattttcattgttattgtatctgtcacggtgatctgtgatcagtgatctccgatgttactactgtcgtttttcggaagtgccacaaactgcatccatataaaataacagaattaatgaataaatattgagtgtgtttcaaattctccaccatccagtctttcccattttttccctctcctccagcctcccaattcactgtgacacagaagtattgactttaggccagttaataaccctccaatggtctctaaagtgttcaagtgaaaggaagagtcacacatctttcactctaaatcaaaagctagaaaatgattaagcttagtgagaaagactttttgaaaactgagataggctgaaagctaggcctcttgtgtccaacagttagccaagttgtgaatgcaaataaaaaattcttgaaggaaattaaaagtgccactctagtgaacacacaaatgataagaaagtcaaacagacttattgctgatatggacaaagctaatggtctggataggagactaaaatagccaaaatcttcccttaaattaaaacctagtccagaacaaggctgtagttctcttaaattctaaaaagtttgagagaggttaaaaagctgaagaagaaaaatctgaatctagcagaggttggttcatgaggtttaaggaaagaagtcatttttgtcacataaaagtgtgaggtgaagcagcaagtgctgatgtaaaagctgcagcaggttgtccagaagatctagctcggatcattgatggaggtggctgtgctaaacaacacatcttcagtgtagaccaaacagccttctattggaagaagatatcatctaggatgtgaagaactacaaaggaaaagtcaatgtctggcttctaagtttcaaatgacatgttgactctcttgttaggagttaatgcagatattgatttcaaagtgaggttggtgctaatttacccttctaaaactcctgagtccctcaaggattatgctaaaactactcatcctttgctctggaattgaaacaacaaagcccaaatgacagcattcctgtttgcaggatgatttactgaatattttaagtgcaccattgagacctattgctcagaaaaaaaattttcaaaggattactgctcaatgacaatgcaccaagtcactcaatagccctgacagcccagtgaagatgtattagattaatgttgttttcacgcctgctaacacaaaatatcttctgctgtccatagatcagggagtaatttcaaatcttaatatttaagaaatatatttcataaggctacagctgtcatagacagtgatttccttggtggatgtgagcaaaataaattataaaccttgtggaacagattcaccattctagacgccatgaacgcttgtgattcataggaggaggtcaaagtatcaacattgatgggagtttgggagaagttaatttcaactctcatggatgactttgaggggtttaagacttcagtggaggaaataactccacatctggtagaaacagcaagagaactagatttagaagcggagcctgaagatgtgaccgaattgttgcaatctcattagaaaacctgaacagaaaaatagttgtttcttgtggatgagcaaagaagatggtgtcttgagatggaatctcctcctggtgaagatgctgtgaacatacctttaaaatgacagcaaatgatttagaatatttcagaaacttagttgacaagacagcatcagggtttaagaggattgacactaattttgaaagaagttctattgtgggttaaatgctctctagcagcatggcatgttacaaggaaagctttcatggaagaaagagtcaattgataaggtaaatttcaatgttgccttattttaagaaattgccgtagccaccccagccttcagcaatcatcaccctgactagtcagcaggcatctatatcaaagagttgcttcttatgggtgagcagatgaagtggtttcttgaaacggaatctactcttggtgaagatgctatgactcttcacaagcaaaaaagtatgacactgaaggctcagatgatcattagcatttttaagcaataaagtacttttaaattgtagcatgtacaatgttttccagacataatgatattgcacacttaatggactacagcataatgtaaacataacttttatatgtactgggaaagcagaaaatttgtgtgactcatttgatagcaatatttgctatattgcagttaacctgaaactgaatccacgatatattcaaggaatgtttgtagctccactgtcctaaaaatcctctgcactcgctgcataccacctattcatcccttcattctcagtattcccttggtgcctacttatcatgtgtgtgtgtgtgtgtgtgtgtgtgtgtgtgtgaggggttgggggagagaaagagagagagcgagagaaagagtactgtgtttctctatatgtgatgtcttagtaaactcactcactgaaatctccagataaaatggtaggagattggaaaataggaattggatggtgtggagttgaaagtagagaatgtcaatggaagatcaagagttacctcaaaaagaaagtgaaacgggaaaagccttactttgattaagttgaggcacagtgggagaaactgttaaatcaggacagaaataaatgggtcttaagagctgttttgaatgcttgattttcatgatggagcaatttcaagtgaaataaaaattagcacgagcaaatgtgtcaatgaaattgtattagggaaaaaaatcactaattaccaacttgagatcctccacaagagctaacctgagaatacagtattaatacttcgctgtgcttcacactccctacctcaccaccagaaagggcaatgttttcaagggacctcttctgtaccccacagctgagctttgcttctgcgactagggaactgcttgagctgacctgagtatgagatcaaacatgaaggtaataaattgattggaagcagaaaacaaaactaaacaacaataacaacaacaaggaaacagtctaactgacttgacatttagatacctggttcagctatacaagttcctaaggatgggaagcttaataatatcaaaatgatgtgactctacaattcacaaaaggaattataatctgaagcattgacatgctaatcaaacagatataagaaaaaatttttactattctagtgaatggaaaatctttaataggggaaaaaagcaaatggcacagatagcgtacaggacaaggacgtaacttaaattgatctgctgtaggacataggggtagactgctctcaaggagacagacatcgaaaatacatctcagtcaaggcaggtggaatttgattaagataaatgagataaaattgtagaaatttaggttaattataaataaaatgggctgggcatggtggctcacgcctgtaatcccagcactttgggaggccgaggcgggtggatcacgaggtcaggagatcgagaccatcctggctaacacggtgaaaccccatttctactaaaaatacaaaaaattagcctggcgtggggtcgggcacctgtagtcccagctactcgggaggctgagggaggagaacggagtgaacccgggaggcggagcttgcagtgagccgagatcaagccactgcactccagcctgggcggcagagcaagactctgtctcaaaaaaataataataaaaataaataaataaataaataaataaataaaatgactgaagagacggatctgaacacaggattaattaatatgacccctcaaaaataaaaagtgattttcacaggttaaatacaacaaaattgataataataaaaatttgtattctaatgttatgtgatatatgattttatgttaatgataatgtagtgagattagaaattgagaaagctcacagtagcccttacaagcaaattaaaaacccttcctggtaaaattctttaagttcaaaagaaaaccatcaataaaagtggttacttttctttttattatttacttaaaaattacaaagttaatatattttcacagtaaaaaaaattcaaacatcaaaaacagatacttttcttctttctacacccaaatctccatttgtcgcctcaaatgtaattactattagtaacatctttggtatgtttccagaatttgcctatgaattttaaaacacacatatatgaagaggaaaaacactgtgataaattaatggaagctttctttttctctccattctaaaaactgtttaatcatttcaacaagccattgttcatttcttcagaggaggataatatggactgaagaaaaacaccaaaattctttctaaccacaaaaacattcgagccgtcatcgtgctccagagtagaaactatcccatttactttagtctccctgacattttgtaggtgtgaaacctaaattccagtggacagagagtatccccgcctgggtgtagaagggagtgtggtgtagctggttactggccattgaaacctgtgccccgtgggcttctcggatgtgtactcgattccatctaagttttggccattggcccagggaggggccatagctattttctccttcataagaccactggccacctcctggcttttgagatctctggtccaaatctgtcctctcaaacatgcacagggcgctatccctccatttctcatatcctgctggcatgtaggcaccctaaggagaagttccaggcccctctacctggacacgtgattctttcagaaccagcacttgctggcagctgaatgatcctgaattctctgatagtttcttggaagaaggaagaacgttctcatctttggatttccaaacctacatgttagctgtaggtatgtcaactatcatcatcactttatttgcctatctggctacttctgcctgcattcattcacctgaatattaatatgcatccttctatttcataaaggaattcatactttagatactcttctgaaactagtaataactatactttggacagctttttataaaaaattccattatagcaatgtaccacaattgattaaatcagtttccaattgttgtatattaattttcatcactttttatttaacattataataaacatgtacatctatgtctgacactttttaaaatatatactacatttgtaagatagactgtttgaagtagaattgcttcgtaagaagggatccaaatttaaaatgagatgaaacttggacatttttattgatgtttaaaatatttcatgtatacgtatgtgtatatgtatatgcacacgcatatgcatacaagtttatatacacacgtgtaaatgtatatgtgctaaacttatatatctgaaaacagatatgataacattatacatgttgaatgactgtactgctaatttcttcccccaattctgtctctctattttccctttagtaataaaactcctaagtttggctagatacttaatggcccaaactctttgcaaataagtgtggttaccttttagacaatagaatgcaaacggataccaacaccagtttgtgattgtatttttataaggaggctgtgtgtctttctctctcattttcccctttccactaattgcaaaatgatacataataataataataataataataataaacaggaggagttgccttgcatctcatgatgaaaaccacaatcaaaggatgaaagagtcaccctactagcttgaattccttgattattttgtggagcagagcagtccaccaactcttgactattcactttagacttgagatttgaaaaaaaaatacttctttttaatttaatctgtataaaatatcacgttatagcaatttatcctatattgcaaatagacttgtttttccttttttactttgtttttcctcttttatcacaatctcactttacatcagcctctctctctccataacctctcttccaaagaatgcatgctaatcaccttgtaattattttttaaacgtagattcagtcatgcaaagacttgtgtatacaaatataaacatatatctacacatatgcattttgaaatttttttctaaaatggaattacattttgtatacttgtctgcatcttacatttcccattcaagaacacaaaatgacaattcctctgagttgactgatacaattttctttctttttaacatgattcttgatttaaatgtaaaatatttcatttaaccattcttctaacgatttccagtcacatttttccagtttattttttgccactgtaaacatattataataaatatttgtatatccttaaaaatgttaatatattagtgttattagaaaaaatataaacatatttttattgaaattggttttgctggtgtgattttcaaaaagattacaatgctgcacattttcacaagcaatgtctgacagtgttcctttcatcacagcctcaacaacagaaaagtttagaattcttacttttaccagtctgatgaacataaagaagtatctcattgttaccttaatttttatgtcttatttacaaataaatttattttcctgtgtttcagtatttcaatttgtgcctttataaactgaaaatgtatatacattaaccctctttctgttgaataatttttatttccattgacacactgtgtaaacttttcacacatacatatgcatacatacataaatatgtacgtgtgtacactttttgtctatcttggtctttgcgttatatttttcccaaataatatgttggtccacttactatgcatatgatatcttttaaatgttcaattagaaaatattttgtgaaatgtctgacatttctttcatacattttgagtttttagaattgttcaagtggatcgccattaaaatgctcatgtgatcgcttagattatcgtgaagtaagttattctttttcacattaaaaatttaatatatatgaattctgtttttctttgtgacataaaattaatatctatttttattttcttccaaaattgcaggttgtccttcagcatttattaaataatattttttccccaaacttatggtactacctttttatgtgcaaaattctcatatacagtgtgatttgtatttgggttctctattcttttccacggatacatttttttctaatttctacacttacagtaattttctaaactatatacatcaacatcaagtagtaaaatactcatttttcatgtcttttatacctttaaatttgtcactcacacacacaaaaaatgcaaccaacaatggggtggaatgttttgttctggctacatggcatcataaattaaacataaattctgttgttaaacccccttccccaacaaaattgaacaactacaacaacaaagacaacaaaaattttaaaagcatagaagtgctagtagaaaaaggaaaagaaaaacaaatacacacacagaaagaaagatgaaatctctatggaagagacacaaaggaggcacacattgtaaataatttggttaaacattacagcagttggagggacgttggtggcaatcagacctgggaatattcgctaataactatgggctttgttttccatggccacagatgcacaagaagtaagctcttgagagcatttaagaaggaagttggaaaataacacaaaaagtgcccctggatcagtgatacactattgtgattggctcagccgcaaagagaaaatcacctggaggtaacagttgctccccaaaggctgcgtggggttttcacagcactggaagaggccacacacaggaggccgacgtgaggtggggttaggacctactgtaacaaactcttatgaatgttttccaaagcatcccaaaagctgcttatttattttataaggaaaatataaaacgaattctaaaccaaaggcgttttcctcattaaacacacacacctgttgtccaattttccatagcttgtttgctactctctctcttgccccaacagtggataagacattctataattttcataaatctatcagcaaatgttaaaaataatgcatcaaaatccaataatgtttatatcagatatgtaattatgtttaatacagggatttctgttatgaaagatatgatcaaaatggccaaatatgaaatagtaaagttgtttacggcatgggcttcaatgtcaaatgcctaatggttcaagtctcgacagaaccgtgtctgtgtgcctattttaccccttccatattagaaatatgataaaacgggaatcaaaggagtccttcttaattgtatagagtggtgatctaaaaacaatagtcattgtcatattcagggtaatttacagatgctttctcttacaaacaggaatgtaaaaggaatacaaaccttcacaactactatgatgggactgacattttggaaaaaaaaaacaagataaaaaactaaaagaaatgagttctaaaaaagacagatttgtcattattttttagcaatataaatacataagtaaccagtcaataaatatacaaaattaatacttttttttttaaatgaagcacaacacaggaaaactatatacaacttagaaactgtcctctccaccagcaccagccacctggaaaatgtattgaaaaaagagatcccatttaccatagtacaaacaataacatgttggcacaaccacaaaagatccgttgtaggacctccagattgaaaaagtcattgcgatgaaggatttgaaagacactttcaaaaatgtaaaatttatagtgtgttccgtattactattacactctccttatacagtatacagaagtaggttctaattttcaaaagttcccagaatttgttttggatatggatgcaatttagattcaaattcttttgacttcaaatttagtcaaattcttttgacttggcttttacatggcttcagatttaatattttatgaaatatttcataatagttatatagatataactattataactatataactatatgaaaactatatatataattatatataactattataactatgtatagctatatagttatatctatataactattatgaaatatttcataaaatactaaatctgaagccatatgaaagccaagtcaaaagaatttttggcagcatggcattggaaaaggaatagaaagacatcagatccatccattaatacataggtgatagataagtataacaaaatagtctctaagaagaaacattataaagatttaatatgtaaaaaatatgcttattctaaataactcagaatgattaggtgattgagaatttgggtgaaattcagttgtgtggggagtttactttaggtaacaaggtaataaacagctggattaaatagtttaatgattcagagaattatcatgggagaaagagcacataaaatattttaactgagtatgaaaaatctagagattaaacaactttttatcccaaaacacaatagaaatattaacagagattagatatttaaggtataaaaattaagacataaaaatgtaacagaatttatttttcacgcccttcgtatggatgaatcacattttgtgtattctttctgccaccaatggacatttacactgttaccacatttgggctattgtcaaaagtgttgtaattaatatttgtgtgtaagtttttatctgaacatctgttttcaatttttctgaatatataccagagtgaaatttgtgggccatgtgacggcattgaacttactgaggaaacgccaaaccatttccatagtggctgtagcattttgtaatctattcccaccagcgatgtctgatgtatgagggctccatttctccacatcctcactaacacttgttatttttcattttaatttttgattattgctgtcttcatggatatgaagcggtatcttactctgctttcgaattgcacgttcttaatgaccaccactgagcgtttttcatgtgcttgttaaacatttgtaggtttgccttggagaaatgtgtattcaagtcctttgccaattttaaaaaagaattatctttttgttaattgtaagagttctttagatatttgggtaacaaatacatgatttgcaaatatttctctctcattctgtgggttgtcttcactttcttgacagtgtaaaagttttctattttgatgttcaagttatttattttttcttttgtttcttgtcctttcattgtgatatcaaagaatctattgccaaatctaaaatcatgtgtatcatgattttttctaagtattttctatgtgtttattctttttattgttattctaaatggaattattttcccagtttccttttctgatcattcattgctaatgtgtagaaatgcaactatatgttttatgttgcattattttgttctgcttttttactgaattcatttataaacacaaataggtttttgatgtgtattaattctttaggatttgctgtatataacatcatgttatgtaagaatagtgctagtttcactttctttacaatttggatgccttttatttcattttcttgcctaattgctctggtgaaaatgtccagtataatattaaacattagtgatgaaacaggacattcttgtcttgctaccaatctcagagagaaaatatccagtctttctctattgaatatgatgtgagctgtggatttttcataaatatcctctattatgttgaggaagctctcttctatttgtaggtttctttgtgcttttatcacaaaagagtgttggattttgtcaaatgctttttgtgcagctgagatgatcacgtggtttttttcacctttgttttattaacatgacattaattaattttagtatattgtagagatgtatgtttcatcctatttttatgacattcttgaaatgacaaaattatagaaatgtaggaaagattagcggctgccagggatgaatgcgggagttggtgtgggaaggaagcggtgatggctgttatagggcagtatgaggaatgcttgtgatggtgatagagatgttttgtatcgaaacgggtaaagggtatactggatttctgtattattttacattctcatgtgaatttacaattatctcacaataaaggttttttaagaaatgtaaatttttgttaagaaaaaattaagtgtgaacaaagaacagaaaagcttcatgaaaatgtttttgatttacctatcctcagtgcctagcacacagtagttgctcaataaatgaaaatataagtgataggattatctttccattgctttaatgtacacacctaaaaacactggttctcaattctaatgaagatgtgtgctgaaaatgcaatttagagttgatgtcaatgcaaatttgtagagtcctatagatatgtaattcgacagttaaaataagatttggagtgataacttttgctttcattttcttaattcttaatgctattttagtctctattacagttatattttaaaatttaattctctaaatattcagcacagtttaatttgacaaaaccttcccattctagttttattttaatgaaataaattgtgtaatatattcaaactattaggtcctctgttatttgctctaggttatcagctaattttttggttaaataaatttaataaagtgctttcttctacaaataattattccaactcttgggaaaacacaaatgaataaaaaaataccattcaaatgtctgttgaatgaagacattttctttggaaagaaaacttttcaagccttaaatggaaaccaccttccctatacatttgtcctccagggtatagccttacatttgattaacttaaacttcaaaaggataaattttatagacctatgttttcaactctaatggatggcatttagcatctattaaacaaatattttaagattgccctaagactgtatacagattatacagttggagctgcaagtacataagcacccagcaggcagataccatccagagcaacatcaaatctcctttgatggccatgcatttctaaacctagctgctatttagggagttactgaattaacgtggattaaaaccctgctcagtggaggataaggtctgctgaagaacagatgttctatatcactaaaaactgtgtgctcatcgtcggaaagatattatgggtctttcatcagatatgtgtctggtggtatcatcaatagggaagaactctgacctcaaaacccaaaacctcggggaagtgaggaaattcatgattctcaaaaaataatcataattaccactttatatcacagtatacttctatcaaaactctactctccctcaatgagtctgtcaaatgaagcaaatacctaaatgctttcagaatgtagtatgagaatgattttttaaatctcataaataaattggaaggaattgaatttctatcacataacatttaggtattaatgtacaagtgactaaatattttccttggcttaaacatcgttaaattcatgataattaattaaaaagaattgtttgtattaattgttatttgtattacaaatgttcatgatatgaattttatacatgtatatgtaaatatatacttttttttagtgactgcatttcataccccatgagcatgaaatgtagcatctggttttgaccgtgtgcattcacttcaaggaaatagggaatagagtcaattatgtaagaaattcaagccaaaatacatttgtgatttatttattcaactatttttatattcaatgttgcattttataaactattgctttatttttcccaggatagaaatgaacaacctggattaaaactctgaagcaatcagattatgtttttctctggacatttactttcaaaagtggcatttaattttttaaaaataaataaaaatgataaaaagtggttagatttattataataatttataataacccaagataggctcctatacaatctggagagaaagatagaggtaaaatgtgagagaaacaaagaagaaaatcttattttttttaaaacaaagaaaattagacacagaatccctgaaacaatgacaagctagagatatgggaagggtctcttgctccaaataattggtttgatgttaaaggtagaagtgcttgtttcacatgctaacaaatgaaggcaaagaactcagctatgttagtgtgcttcaaggaagagttcgttctctttcagcctgtgtcccacgtttaaagtgaagtgtgggtatgaaagttgtatggtacacacttgtgttgtttgactaattgtttggggttttttttggtaaggaaaaaggaatggatagagtaacttatacctcaaacttttcctggcacttctcaccttgttgccattcaaaaatttcgacacgttttaactctactcatgttacgatcagttggagaaaacaatcgcttttccttcaaacttctttgtaatagatgatgatgttgcatgagtcctgaccagcctttccgagagagggctcagtaaatttctaaggtaccaaatgtattttgaaaatactgagccatcaacctgctctttggtaaatctagtttaataaataccaaaatgagcagaccaagccatctgtgttctctctgcttgtaataaaaaaggcatttgtctgatgatgacatgtttttcagagtgcaccaagtactttattttatgatggtatttatgcagcttcctctaaatgaaataatgcaagatgtttattatttcagcatctgctcccatattctcttagccacttcaccagtgactcacatttctttgacacaaaaaaaatcattagattgtttcatctgataattacacaggtaggtctgttttctttttggcatattgttgactttcaatccaacaagtgctatcaaagagaaatgttaatattttgaattaagggaaagagaaaaagtgaaatggatagtaatgaaaagtatttataaaccagttctgatcctgtttaaattgctattgatacatttattgataccccctcctggtttggaaggatttaatatggttgccctgtattagattttgaattcctctcatgtgaccaagaataagatttttaaaaaccacaaatattcacaattgttgttactatcattattattgtttcattctcagaaccactaaggctcagctgctttccctgtatttacatactagagaagtaaatagtgacaagtgttaagtattcacttgaagatcctgctccagaatatctgcttggttgtattttcattgtgctaaattctgacagttaacacgcttctcttaaacacgatctctaacatatttcatgcatttgtacttacatatatactgtagaacttcaggaaagtcacctctaattcctgaatcaaatagtgtatactgaatacagagctgcaggggaatacatgatttactttatataactgcaattaacaggagtaggaaagatgtttacatttagtagcctacttttaaaaaacaaacaaaaacaaaagaagacaatagagagctcatttgaggatagcacatattacatagctcatgagttggaatgttgagctagcactcaggtgcagaccacactggagtgtgaggccatcccattgcagtctggcctctgggtgcccttgttgcaccagttagtttttaaaattctgggtattgccttggcttattggggattttacatcctgagaaaaatcatagatcttaataaataaaccaaatgagatcatgcattacatgattaccccaaagtttcgcctttcattttttattaatgtagatattccatgttaattggatactactgtattcccaaatattttacctagaagatgttgttaccaaggaagacagtagaggacttggtgtttgaatggaaaagagagatgtggagggtggaggttttcaatattagaagagggttaacgtggggtaaattgagataaaaaattgggttttggtcatgttgagattcagattagtgataaggctagtttttgttactggttaagccaatggattacattcacaaatatattaaatattctcaactgcagtgactgtgactttcatgtaatcagaaaccactactagattttactgactaaaacctacaatctacttttaacactttgctatgggtataaaagaaggggaatgaccacactcccacttccttagcccattcatcacacaggcatagttggcatatagtgtctaaaccaatacctaaattcatcctattggaagtgagacagtggctcaaatgagtaccccctgattgtctatagagcgtaagaaccacatcagggtccagaagagagcaagccaaaacttgaagcctgtgatcagaacgctccctaactctgcgaggccagagagacgtgttgcaatttacaatgtgctttgctcgttcccagagttccctaacatgaggttctttgcttgtggggtgtgagtcaagcttattcacatggttaagaacacattaaaacaagccgacaggaagtttccagtggtccttggagatagtctaaaatatgaaacgaaagaaaataaagagatctaatttagcgaacaaaacacgtccatccagactcataaacggtgtgcttatgttcttattccgttttattttggtaatggaaaaaaaggcttggggcaaatacacaaggataattcatgtttccttcttttagctcagagctgctgtcctcacttaacccctccagccacatcaacttaaccttgacaaatcaattatttttctttcaggaaaaaatcactgttattgccaatccatagaacccattaacccttcaagaaagaaaccatcaaaattatgattttaagatctcaattcagaaaactttcctgaaataataagcgcacacaccttaaacataattggaggattcattctaagaaatcctcttcccagtttcctcagaagtctttagagctgtaatacagtgtgagctctcaaaagttattaaaacaaagaaaaaagtggtagcaaaaaatatgaaaattatgaagaaaaggataaatagaatttttttctaattttgtatctttttcatttatatatattcagcaattttgcaaggagaaggagcaattttttatacatttcagtacagacccacaaaataaaagtccgtttttagtgacaagttaaaattcaatataacctataattagtttagcagtatgataaatttcactatttatatctaccttctaataatcttacattacaacgaaagctgctattttaggtaagttaccctctgctcctcatgctagggaggaaaaaagcaaaatgtgtttagactccctggcattttgaaagtgttgattccaatcctcattgagaagacaatgtgaggtgtttgactcagattcatgtatttcagttgccatgctttaaactttaataattaaaggaatctttttcaaaaactcatcaaaatcttagaggtcaggatagttttataatatctaccaagggataaacgaagtagtttatcccatttgtaattaaaatgctccaacagagagcaccttgctccattatgaggacactttgtgaatttgacactaatgtgtgtttaccgttttaaatttttaaattctgacgttctaacaaacgttctaagggtacataggttagatataagaataattatggtctgtcagtattaatgactgtttctcataatcattaatggaaacaatttttttgttgttttcctatcagataactccctttcttattttcacaaatatctatttatgatatttctgttggttatttaggagtgcagctgtgcagctgtaatcatctatcactagacaactattaagtttttcatcatgttttaccaaagttaatttgcaaaagcttttttaatgttcactaatggtcttttctgcattaaaaaaatgaaagctcaatcatgctattttatgggataggtgaagaatccattacacatttttctaattaattaaccatttcctaaacatatggataaataatgcactaaagcactattggcatgtattactgtttaattttagaatgctctatttacacgtagtaggcctaggtcaaggcgggatgctctgctctgctctgctctgctcattgtgtgtctcgttttcagcagctgcactgtgtctttgtatgtgggcttcatgatctcttttaccatatggtatcctgtcttcctcactgtgttttccaataaatgtctacttattcttgcctgtttgcttctgttgatcaactttagaaccattttgtaacttttgtgtgtgtgtatgtgtgtgtgacagagtctcactctgttgccaggctggagtgcaatagcacgatctcggctcactgcaacctctgcctcctgggttcaagcaattctcctgcctcagcctcccgagtagctgggactacaggcgtgtgccaccatgcccggctaatttttgtatttttagtagagaccgggtttcaccatgttggccaggatggtctgaatctcttgacctcatgatcctcctgcctcggcctcccaaagtgttgggattacaggcctgagcccctgtgccctgccataacattttttaaagcaccaaaaggaatgtaattgggtttctgttttatttacatgttcacttgagacaaatagaaggtttcccaatatatattattcacattcacagtgatgttatatagctccattaaaaactagtaataatttcagatttataaaaatttcaaacataaaattaatacagagaacatgtgtatgcctttcaccaaggttcaaatattaacattttattccatttgcattgtaatttgcccatgttctctttctgtgaattttttttctctgaactattcaagtgtaacacatcatggccctttacctgggacttcctcggtgtacattacattacctaggaacagggatcgtcttcatcaatttctattgatagactacatttaatttcttatttatattcgttttattctatttgacttaataatgtcctttataccatttccccccttcagaaccgggtccagttggggtcaagaattacatttagttgccatgtctctttaacttcctttaatctagagcatatccacatatttctttatcttgcattatttgatttttttaaatccctccattttaacagacttgtcctcattttgagtctgttggttagtctaattattataattacactgaaatgatgtattcctggtccaaatatgaaatatttagcattacactcttcacagtgtagcacatctggaggcccatcactgccatgcgctctttcattggtgatgttaatttcatcacctggtcaaagtgttgccaaatttctccgttgtataattactatttgctttttctcccttccacctaatttcagattgaggggagattctttaaggcaatgcaaataccctgttcttcatgaaaccgctccctagatttagcacccatccagaagccttgcctaacgcactcttgccctggtggttgccaaaggatgatcgttcacccagcacctctttcgcttcttgaagtcacccttaaccattctactgcaacaaacagcccccctcttaaccccatttatttattcattattaatgtggactcagtctattttttaatggtgtatcattcagatgcactcattgggacgctgtggtgggaagctactcaagctggctcccgcaatagaccccgtcattttttaagcacttctttactttttggcagaactagagacctggctcatcttgtattgtcttgtcccagccctgtaacgagccattttcctgaggaactctggtttccagatcttggcattcggtatgtccgttgttactggagtgcatttgcatcatggtcctttcagagactagacctaggaaatacatgcacacacacacgtacgtatgtatgtccacacacacataaacagtcatgaatatacacatacacatatgtattttaggaatcatgagctcacagcaatacttccaattccaatcctaccagcagggttttcttcactctcctccattccgtacttagatgccctttcttcaacatgggcagcctgagctccccaccacctcaacacattgatctatggttcaatcctggaatacatctcaaaaggtttagtattgctccaccaggacctctacattaacctacctcaaaataacttattttcaactgcttttgctgtactccaacttttctttacaactgagtataataaactattgtatttataagttaataggattagttttctctaagctatgtggccctgtatgtctctttgtctttctccttcagggtgcttgtgatagtcgtttgaaataaagttaagttcatttttaaaagtttacttatattttagagttttcttttgttcctttctcattctgattgatttaaatatattttaaatatatgtagtattaacatgctatctgctgtggtgtgaatatggtttgtcctcaccaaaactcatgttgaaatgtgatccgtgatatggcagtgtttcaaggtagggcctagattaatgccctcccactggggtgaatgagctctcctaagaacagggattaggtcccccgagagaagactgttaaaaaaaaaaaaggctggttttcttggtttcactgtccagtttcttttgtcaccatgcgatctctctgtatgtactggctccccttccactttccagcataagtggaagcagcccgagatcctcaccagatgcagttgccccatccaggattttccagccaccagaatcacgtgccagataagcctttcgttgtttatagattacccagtctcaggtattctgctacagcaaagcgaaatagaccaagacactatccaaagtcaaaaggcacaaaaacttatactcagagaaggcccaccccaaccctgtcctttcccattcatactcctctccaacactttaaacaacatcattgttttctaatttatctgttccttttggtagcaataagcagatatatgcatgtttttctctttgtcacacaaaagttaggatattttttatggcttccttttacgttttgatttttttcatctggtaatatctcctgcaaagaagtcactgtcaattcacagagcccttcctcatcctttcttacagatgcacagtgttccgttgtatgcatgtgctgaagtagatataataaatctcccatggttaggttttccgatagtttccaatatatttacaattacaaatcatactgcaatgactaacattgagcatgtgcatttgtatattgttggaggtttacttgtggaatcaattcttaagtgtgtgatttctaagtggaagggtaagtgcatacataattctgttgtacaaatgcaaatttccctcctcaggtattccactttgcatttcaaacagcaatgttgggagtgactgtgtttccacattctcaccacagagtatattgttaagcttttcaatttgtgtcaatctgatcggagatgggtaaaaaatggtacctgagtattattttaattttcatttttgttattataagtgaagttgggtgtatttttatatacatacaaagggtctttaatatctttttgaaaattatatttttgtccattcttatataaaatttcaaattttaaaatttctataacatttttgctagtttgtctcctaaattttaaaaaagcttttgtaaaattaagtgaggggtattagcctttaatctgtgatatatcttgcaaatatcttccccagagtatcatttgtcttttgacattacttacgttgttttagccatgtaacttcttatatttatgaacattaattaattaatcttatattttattgcagctggattattatagttagaaagtcattcgttgtagctagattataaaaatattttcacatgttttcttgtaggatttttgtgtctaaacatctaaatttagaactctcatccacttgggtgttttatagagggtggtgattggatctaaatttaccctttccaaatggctgtctagttgtccatctccatttattatgaagattacattttgtccctatgactgataaatcaccataatacactgaatttctgattgtagttgaatctattcgtggaggttgtattctattccatttaattatcttttcattgagatgccagcataacacgttagtagttatggaggcattgtggcatttataaattgtggtcaaaaacacaacacataaaatttatcatgtcaactattttttaaatgtacagtagtgttaactatatgcacatcaatgtgcaacatatctgtataacttttcatcttgcaaaatgggaactctagatccattgaacaactccctgtggcctccctttagaccaagcttgtccaacctgtgcagcccaggatggctatgaatgcagaccaacacaaattcgtaaactttcttaaaacataatgagatttaatatttatgcatggaccttttttttaagcttatcagctatcattagtgttagtgtattttatgtgtggactaagacaactcttcttctttcaatgtagcccagggaaactaaaagattggatacccctgcttcagattctgatgaccatcattctaccttctgtttctatgggcttgactactttggatacctcaaataagtgaaatgatgcatttgtcttttggtgaccggcttaatttacctagcacagtatcctcaaggctcctccaagttgtcacatatggcaagatttccttcctttaaaactgaatagtactccatggtatgtacatgttatagtttctttattcattcatctcttgaggggcatttatgttgcttctactttttgactattgcaattattgctgcaatggacgtggatatgcaacaatctctttgagaactttctttcaattcttgtggatatgtactcaaaactgggattaatttttttaattgccatgctcatttccatagagttgcataatgttatcttcctaccaaaaatacacaagggtttcagtttctccacattctttaccaacactagttatttgcttaaaaattattcattaatttttattgacacataataactgtagatttatggagtacaagtgaccttttgatacatgcatacaatgtgtaacaattaaatcagagtatttacaatatccaccactttgaatattttgctggaaacatttcaaatatctcccagctattttgaaatatacagtaaactattgttaactatagtcacccttagctatctcatacaggaaattattttttctatttaattgtatgtttttaacctttatccaaaccgttgtcattgccccctacttcaaacacacactccatttcccagcctgtggtaactatcattctactctctacctccatgcgatcaacgtttttagcttctgcatatgtgtaaaaacatgtcatatttgtccttctgtgcctggcttttttcacttaacatactgttctccagttccatccccgttgctgcaaatgactagatttcattcctttttatggctaaatactattgcattgtttatatataccacattttctttatttatacattcattgatagacacttaatttgattccatatctttgctattgtgcatagcacttcagtaaacctgagggtgcagttatccctttgatatactgtttcttttctctcgtataaatattcagtagtgtgattgtggaatcataaggtaggtctattttttagttttttgagaaacctccatatttttttctacaatagatgtactaaattactttgccattaatagtgttttagagttctcctttctttgtatcctcacaagcatttttttttgtcttgaaaatagctattctttttttgttgttgagaccttgcttgttgcccaggctggagtgcaatggcaccatctcagttcaccacaacctctgcctccccggttcaagctattctcctgcctcagcctcctgagtagctagaattacaggcatgtgccaccatatccagctaattttgtatttttagtagagatggggtttctccatgttggtaatgctggtctctcacgcccgacctcaggtgatccacccacctcagcctcccaaagtgctgggattacaggcctgagccaccatgccctgaccaaaaatagctgttctaattggagtgagatgatatctcattgtagttttgatttgcatttccctggtgataagtgatgttcagtattttatcatacacttgttgaccgtttacatgtctccttttgagaaatgtctattcagatcttttgcccactttttaatggaattattatttttttcccattgagttgttcatgttccttacatattttggatattagtccctggtcagatgaatagtttgcaaatattttctcccattccacatgttgtctcttccctctgttgattgtttctttgctgtacagtaggtttttagtttaatatagttccatttgtctatttttttttgttttggtgcctgtgtttctcaagtcttagctataaaaatctttgcctagaccaatgtcctgaagcatttcccctatgctttcttctagtagttttatagtttcagtgttgtgtttaagtcttttatccattttgatttcattttttcttttgtatttggtgagagataagaatctagttttcctttttctgcacatggatatccagttttctcagcatcacttactgaagggactgtcctttcctcaatgaatgttcttggtgcctttgtcaaaaataattttgctataaataagtggattaaatttatttctgtgttcttttttctgttaccttggtctatgtatttggttttatactaatgccatactgttttgattactgtagctttgtagtatattttaaagtcaaggtagtgtgatgctccagctttgttctttttgcttggtattgctttggttatttggggtattttttggttccacataaattttagattttttttctgtgaagaataatgttggtatttagatggggattacaataaatatgcagattcccttctgtgatatggtaatttttaataatctcaattattctgatgcatgagcatatctttccatttgtttgcatcctttttatttaccttcaacaatgttttgtagtttttattgtagaagtattccacctcctcagctaaatttattcctaggtatttcattttattttttgtaactattttaatgggattatcttcttgatttccttttcatctagtttgttattgatgtataacaaagctactgatttttgtatgctgattttgaatcctgtgttgtgggaagtcagggacctcaaatggagggaccggctggagccgcggcagaggaacataaattgtgaagatttcatggacatttatcagttcccaaaattaatatgtttataattttttacacctgtcttgactgcaatctctgaacacaaattgtgaagatttcatggacatttatcagttcccaaataatactcttataatttcttatgcctgtctttactttaatctctgaatcttgttatattcgtaagctgagcatgtacgtcacctcaggacgactattgtacaaattgattgtaaaacatgtgtgtctgaacaatatgaaatcagtgcaccttgaaaaagaacagaataacagcgattttcagggaacaagggaagacaaccataaggtttgactgcctgtggggtcgtgcagaatagagccatatttttcttctggcagagagcctctaaatggacatgcaagtaggagagatattgctgaattctttttccagtaaggaatattaataattaataccctagggaaggaatgcattcctggggagaggtctataaacggccgctctgggagtgtctgtcttatgcagttgagataaggactgaaatacaccctggtctcctgcagtaccctcaggcttattggagtggggaaaaaaatcccaccctggtaaatttgaggtcagaccagttctctgctctcgatccctgttttctgttgtttaagatgtttatcaagacaatacatgcatagctgagcatagaccctcatcagtaactctaattttgccctttgccttgtgatctttgctttgccctttgcctggtaatctttattggcctcagaagcatgtgatctttgtgacctactccctgtttgtacacccctccccttttatagtccttaataaaaacctgctggtttgcgggtcaggtgggcatcacaaacctatcgatatgtgatgtcacccttggtggcccagctgtaaaattcctctctttgtactctttctctttatttctcagaccggccgacacctagggaaaatagaaagaacctatgttgaaatattgggggctggttcccccgataatcctgcaaatttactaaaattgtttatcagttctaagagttttttggaagaatctttatgtttttgcatatctaagattatgtcacctgcaaaaagagaccatttgacttgctgttttcctatttgaatgccttttatttctttctcttgcctggttgctccaactaggattttcagtactatttttgaataagagtgataaaagtgggcatacttctctttttccagttgtggaggaaaggttttccgcactgccccattcagtgtaatgttagctgtgggtttgtcatacatggcctttattatgttgagatatgttcattccatgcctaactttttgagggttgttatccccaagggacattaaattttaccaaatgcttttttctgcatctattgagatgatcatatggtttttgtcctttattctattgatgaggatttttatatctttgttcactgggctattgtataacaaagccactgttccccagtgaacaaagataaaaaaatcctcaacaaaatactagcaaaccaaatattacatcaaataaaaaaataatgcatgatgatcaagtaatgtttatcccaggaatgcaaagatacttcatcatacataaatcaacaaatgtgatatatcacatcaatagaataaaggaccatatggcttaaaactcatcctcaaatataacaagcagctatatgaaattacggatgtagaccaaggatgctgaacataccataatggcaatttcatttggttaaatctaatacttatatcaatggtaaattatcaaattatcaatcacattaatctctctgaagtcattttctacattcatataaggcataaattctatacataaactattttaagatataggttctgggatctataacctgtaaatcaagagttattatctttgagagtatgtattttttatattctcaactcctataagagatattttatgtaaatttaatggtttcctaataactaaagtggtacattaagcctcattttttactcttcctccacaaaactcaggaaactaatcaggttgcctgtagttcaatgttgatcaagttaattatctcaaggattattctcattttgtgacataatatattatccattgttgtttaattcccagcaaaatagagacattttgaaaataattttcactgactttttagaattcaagtggctttcacaaatgaaataactttactatcttgctgttattaatctgtacattggctaatctgactttatatcatcaagatgactattttatttgaatgagcatgaactcataaaatctttacaattcctggcttactcaagagacaatcatatagtataaaacagtactcaaattaccatcagcatttattttttcattacaacctcattacaaaactatttatcatgtcgtatagttcaatataaagctggtcaagggatctttataaccgagtgactgataagattattgtcatattttgaaaggcaccaaagggctttttcaaaggacaagacctcagaacagttttatgttgaagtgagaccccagtgtgcctataatagctttattgagatagaattgacataaaccatacatattcaaaatatataatttgataagttttcatctatttataagcctgtgaaacaaccaccacaatcaagatagtgaatatgatttattttaattttatttgctttcaaaataaacatagctatgttttcagaaaatccaatttttccttaaatctgcaagttttatggttccatttcatttaaaaattaagtcatttttcaaaaatgatagtgtgcacagttttattaaagtaattaccatcaccatcattgcaacagcaagagcagcagctacaaaaactcagcaggtcatttttaatagatgcctttttctcactgacataaaacatgagcatctttacagtacaggttacagcaggatggcccatgatggttcatgcaatcgtatcactgttattgcctcaatggacattcctgggtgctcacttaccagcagaagtattttcctcctcagaattcttacctactttgttctcctctgccatgctctactttctcttttctcatctatacttttgggataattttgatataaaaatatgcccaaagagttagactggaaattaaatgtccctcataattcagtaaataaacatctggataaaacagagtttctaataagcttagggtttgttggaataatactcgtttaataaaatactaatttattgaatgcttaaatgaattttttatattaagaaaacgagttagaaaaattgaaatacgaaccacagaaatgtgtatttttaattacagggctttgaataaaaaatgaaatcagttaaaaattggaggtcagccattcactgtgtagattaggattaattagtactgatacatatatattttcaaaatattccattgctataataaatttccattttggtattaagaaaacgacggaaggatatatggctgattgcctagtccatgactttgtgacatattgagacaagggtattatatagaaataataaaatatctctttagatttaaatatatatattttcacatatatttatgtctaagctaatagatatttttgtactaggtaatatgaaattgctcaagagtgctgaaataatcgtaaagaacagtaggagccagttttattgggcagtaagttagaattactttaccagctgtctccagtaactacagcaatactagactgtagaaaacactcaacacatagttgtttaatgagtgagccattaagaaaaaagaatagatctcaggttaacttttattagtgcagcagaatattttttgtaaagaaagaaaatattttatactagttttctctggctactgtatatagatagtaacacactttccaatttgtggagtatatttaaaaatatacattagcaatgtctgagaggagggaagttttattagtagaaagataaacaaaatagtagtgatttattaaaatttgcaaatatattagttataaaacaggaaaagaacacgtggaaagcaggagttttgaatttcaatttcatcacattttcttaattagaataatataattgaaatccagctcttccccaaaaggagattttcccttgcaaacaacttactcatttcctttcactttttctttctctctctctctctcttttttgtttgctttcagtcttttccagtttatttccaaagatgtttttatactcagtgagttctcatcatggcagtattctccacaatgtattcctagagtttcaacttagtttttctcttctctgatcctctccttatcctggctgtacttcacggcctggcagttttctgggaggctcctgtctatcgcttgataccagaggagtggatcaaaattgttccagaagtgaattcaggaagacagtgggcaattaattcaagatttatttttctatataaattgcagaagagaggtagtttggtggaaaatctcatcataataaattgtgaaagttatatttattgagacctattttcccggcatttattccttcttatgctattttatttacttcttatatctctcaaaaacttgagaaccatatgcattgttcaatgccatacacaattagtaggcaatagatggcaaaatccagagtcttatcattaaacgttttagttttttgagaacattatagttttataatgcttaattaatgtattgcttttctaggtacttattatactcaattcactcttttagatgattagaattttataaagatgtatagtgagcctgccctcagttatatgttaactttgcttattgccgaaattttccctgagatttggaatttatcacaataattagtaaataatatcttcttaaactaactttggaaaatttctatccaataattcaaaatatttgactggcaatcaggtaaattaaactgtgcaatacagtaggtagaactctgtgggctttgatatcacacaaacatgaatttaaagatgattcttccacttgtgttatcacaggcaattgaatcaattatgacattcttcagttcattactctataaaaaagggaaacgaagaataactaccttgtaatgcagttgtaaaggttacttgaagcaatttaggcaacatcaccaactatactacctagctcatcataaagactccagactgaatggtcactattgtccatttggttagactcatggttaaaagtgcagctctagaagtctgttgttggcatggatgggtcagctcctactagactaaatctcccactaatagcaacaacacattataaagtatataaacaaagacatccctaaagttgtgaagagttgacaaactatgcagttgctggaggggaagacttggaaaatgaagatggaaccgacacagggtgagcttgctgtttgaccatttttagcatgagacaagtctgcattaacatgctacacgagaagttcttcagttcctctggcctggataaagaggatggagttgaggtgacttactggttctgaaaagtaaggaggcagtcccaggaagcaaagaagcaggcaggggcttcagcttctgtttaagaaatctttccaagtctctggctgacttttcaatcatgcagcttccagccagactacaacagtagaaataaatgagcaaagacaaaagctcttacccaagcagtaaagtttgcagtttgagttcaagctagttaattacctcctaaaacaaaaatattaagacattttggggcactaaaacagaatcaagattcacaatataacattaacaaagtccaagatactacacaaaattacttgacatataaggaaccatgaatatgcaaccattttcaagagagaagaaaataaattggagtcaatccaaaaatgaaccagatgttggaattagcagagaaaggaatgaaagtaaatattattactacacctatgacaggaaggggacaggctcacaatggagggcagagactctcagcagagacataaagaagctaagaagaaccaagtggaaatgttagcgccgaaaaatgacatctgagattcaatattcagtggatggcattaagatcaaaatggagatgaccaaggaaggtattaataccagcaaacatgaagatagttcaatggagaggatctggtctgaagagaagagagaaatatatttgaaaaagtgttgaaaagaggctgaaaccaatgaggcaataccaaaagtgccaacttgtgcatagttggattcccagatggagggagtggaaagcgagaataagacagacaaaacataaataaataacataaacataaatgtaaaaacagcatagccaggtattcctccaaattattaaaagttgtatatttatatttcaagaatcccagcaaaactcacacagtgtaaatgtgaagaaatctatgcacaggcatatcatggtcatgattatcaaaagcagaattaaacaaaatcttatatgtgtatagagagttacacatagaggaacaaatgggccaatattttcaaagtgctgacagaaaaatactaaagacttggaattccatactcagtgaaaattaatgtcctttaacaataaaagttaaataaaaacttcttcagacaaatgcaggtggagagaatttgttgcaaagagaactgtcctacaaagaagcatcaaaggacatctgtgagactgaagggaaatgttaccatagggaaactcagatcttcgggaagtaaaacacaataccagacatcagaaattatttggaaaatataggagaaatgttaaaggtaaaattacatttaaaaatttaaaacatagaaacatatactttgtttttgagacaatgtgtccctctgtcagccaggctggagtgcagtggtgagatcacagctaactgcaacctcgacatcctaggcaaaagtaatcctcccacttcaggctcctgagtagctagaactatcctataggcacatgctaccacgcatagctaatttttaactttttgtagcgtcaaggtctcagctatgttgcttcagcaggtcttgagccccagttcctggcctgaagtgaaactcctgccttggtttcccaaagtgctgggattacaggcaagagccaccatgcccagtctaaaacttcctcttaatttttttaatatacattggaaaaagctgatttcctgtaagtgtccaaatgacaaattcccagctagacagatcaaaaacatatagtgagatacaaattgcagatatcaagaatgaaagaaaaattaaaactagattttgcagaaattaaaataatattaagaaaatattgccaggtgcagtggctcacacctgtaatcccagcaatttgggaggcctaggtgggtggatcacctgaggtcaggagttcaagaaaagcctgaccaacatggagaaaccccgtctctactaaaaacacaaaattagccaggcgtggtggcgcatgcctgtaatcccagctactcaggaggctgagacaggagaatcgcttgaacctgggaggcagaggttgcggtgagctgagatcacgccattgcactccagcctgggcaacaagagtgaaactgtctcaaaaaaaaaaaaaagaaagaaagaaaatattaagaaaaatttatcccactaattttgaaaactgagataaatgaataaattctttgaaaaatacaacttaaactgtaagcaaaaatgtaaaaagagacactaagatgaaaggtaaatgtgttaaatttattaaatacatttttattaaattcattttttaaattattaaattatttataaatttgtttaataaattttaattaataatttaattatcaatttaaccaataattttattaatccatttaacaaaatttaattaataaagttattaattttatttaacaaaacacattttattaaataacatttaaatgtattaaataaattaaatatttatttattaatatatatgctgccgaagtgagcactatttatttgtttttattatactttaagttctgggatacatgtgcagtaatatatgtgccatggtagtttgctgctcccatcaaccaatcatctacattaggtatttctcctaatgctatctctcccgttgccccccaccccacaacagatgctggtgtgagatgttcccctccctgtatccatattttctcattgttcaaccccacttatgagtgagaatatgtggtgtttggttttctgttcctgtgttagtttgctgagaatgatggtttccagtttcattcgtgtccctgcaaaggacatgaactcatccttttttatggctgcatagtattccttggtgtatatgtgccacattatttttatccagtctatcattgacgggcatttggattggctcaaaatctttgctattgtgaatgctgttgcaataaacatacgtgtacatgtgtctttatagtagaatgatttataatcctttgggtatatacccagtaatgggattgctgggtcaaagagtatttctggttctagatttttgaggaattgccacactgtctgccacaacggttgaactaatttacactcccaacagcaatgtaaaagcattcctatttctccacatcctctctagcatctgttgtttcctgacttcttaatgattgccattctaactggcgtaagatggtatctcattgtggttttgatttgcatttctctaatgaccagtgatgatgagcttttttctatatgtttgttggccacataaatgtcttcttttgaaaagtgcctgtttgtattctttgaccactttttgatggggttgtttgtttttttcttgtaaatttgtttaagttatttatagattctggatattagctctttgtcagatggataggttgcaaaaattttctcccattctgtaggttgcctgttcactctgatgatagtttcttttgctgtgcagaagctctttagtttaattagatctcatttgtcaattttggcttttgttgccattgcattttatgttttagtcaagaagtctttgcccatgcctatatcctgaatggtactgcctaggttttcttctagggcttttatggttttaggtcttacttttaagtctttaatccatcttgagttatttttgtataaagtttaaggaaggggtccagtttcagttttctgcatattgctagtcagttttcccaacaccatttattaaatagggaatcctttccccattgcttctttttgtcaggtttgccaaagatcagatggttgtagatgtgtggtggtaattctgaggcctctgttctattccattggtctatatagctgttttggtaccagtaccatgctgttttggttaccgtagccttgtaatatagtttgaagtcctgtagcatggtgcctcccaccgtgttctttttgcttagtattgttttggctatacaggctcttttttggttccacatgaaatttaaagtagttttttgtaattctgtgaagaaagtcaatggtagctggatggggatagcattgaatctataaataactttaggcagtatggccattttcatgatattgattattcctatcaatgaacatggaatgttttttcatttatttgtgccctctcttatttctttgagcagtggtttgtagttcttcttgaagatgtccttcacatatgttgtaagttgtattcctaggtattttattctctttgtagcaattgtgaaagggagttcactcatgatttggctctctgtttgtctattattggtgtataggaatgcttgtgatttttgcacattgattttgtatcctaagactttgctgaagttctttatcagcttaaggagattctgggctgacatgacggggttttctaaatgtacattcatgtcatctgcaaacagagatttcacttcctctctttctttttgagtaccctttctttctttctcttgcctgattgccctgtccagaacttccaatactatgttgaataggagtggtgagagagggcatccttgtctttgggcggttttcaaagggaatgcttccagattttgcccattcagtatgatattggctgtggatttgtcataagtagctcttattattttgagatatattccatcaatacctagtttatggagagtttttagcagaagaggtgttgaattttattgaagggattttctgcatctactgagataatcatgtggtttttatcattggttctgtttatgtgatggattatgtttattaatttgcatatgttgaaccagccttgcatcccagggatgaagctgacttgatggtggtggataagctttatgatgtgctgctggatttggtttgccagtattttattgaggattttcacatcgatgttcatcagggatatttgcctgaaattttctttttttattttgtctctgccaggttttggtatcaggatgatgctggcctcataaaatgagttagggaggagtccctcattttctgttgtttagaatactttcagaaggaatggcaacagctgctctttgtacctctggtagaattcagctgtgactccatctggacctgggcttttttggttagtaggctatttctgcctcaatttcagaatttgttattggtctattcaaggattctccttctttctggtttagtcttgggagggtgtatgtgtccaggaatttattcatttcttctagattttctagtttatttgcatagagctgtttatactattctctaatggtagtttcgaatagaactaataaagatagggtaagagatttgctaattaaaatttgacaatgtctaacactgagatttagttagaaataatattctttatgtatcttatagatatgttaggtgtaggctttatcaggtaataagtaagaaagagtaaagatcaatgtatttcttgatctcaaggaactttttaaattcagaataatgcattttcacaattttaaggtgctatataggttacattttcatatacctataaattatatacacatctaaaatcaatttattttagagattagagatatgagtaaatttgatataaattattagcataaacattagctatcaaccacttttgaaatggtactcattaggaggttattctccaactaacataaaatttcttatatcatttttctatatgcagagtagagaaattcaagccataataatagttgctatttaagatagtccagctctgctcttttatggaaagaaaaattataagaattcaagaaataacacatatacaaatatcaaatttttgtcaaatttagagacaagattttataatgttcatcttaaatcatcacaataagaaatagtttagatccagatttatctcttattaagaattcctatcaattataaccagatttcatatcagctttgattctttttttgtttttccactgtactatggtttaaatgtgtcccaaaaattttatgtgttggaatcttaatccctaaatttatacgttgattggaggtggaacatttaagaggtaattaggattaataaggtcctgagggtggggcccccacaatgggactggaggctttataagaagagaaagaaagagctgagttgacacgcatgctcttgccctcttgccatgcgatgtcctccaccatattatgacacagcaataaggcccttgcaagatgtcagctccatgctcttggacttcccagcctccaaaaccataaagtaaataaacgtattttctttaaaattactcagtctcaggtattttgttatagctacagaaaacagagtaagacaaactcaatctgatgacacacgtcaactggtagacacaggtagcttctttagctgagtcaatctggttcgtgagatgtagaatatagcaaagcttacagtcaaagggtagggccccaactgctatctattttgtcctccaagtcatatttactaatagagtaaagattctagagcttagaggagcgctttagtacctattaccccctaagaaacaccatccactgatctgggggcatagcttctgcctaagtttggcttagatttgcattctgattgttgaatactcttgtggcctcactctttttacattcacaattagaactggagaccaaatttccatttctctggctaggctgtggtgcctatcaaacacagtttggagccaagaggaagaaactgcaggaatatacagactgcctgcatgatatacttctcaaatattacaacttaatgtcacaaaggtgaagaaagatatgtagttgacccttgacatgggcttgaactgcatgggtccacttatttgtgagttttcttctgcctctgccagccctgagacagcaagaccaacccttcttcttcctcctcctcagcctactcaaggtgatcaagacaaggatgcaaacctttatggtgatacacttccatttcataagtagtaaatacattctctcttccttatgagtttctcaaaaatattttattttctcttgcttactttattggaagatagtatctaatacatataacctagaaaacgtgtgttaattgactgcttatgttatctgtaaggcttccagttaacagtaggctattagcaattacgtttttgagaagtcaaaaagtatacaaagattttagggtatgtgaggggtcagtgaccttaactcctgcattgttcaagggtagactgtatatctgtaaaaaatgaatcacatttatgcttacaaaatctatgtatctgtttgtgttctggtagtcaacattgtacactttgaatgtactaattaaaccatgaactattaacctatgaacaccactttatggagcgatctcctacactatatcatactgtgcccctttgcccagcacttcagctctgtgtagtttccctttttcagatcatggtgctgttttcataacctccaagcatcaataaagatgttatcaatgagagacaaatctttcaatgctgggctccagacagaatttcacaaaatggcagctcctgtattttctcttatttgtgctccaaatcatcttattctcctaatttggaaataacccaccccaaaataactttaaagagccaaatatgttagaaagcaaaatgtagaagtattataagaaaatataggcaaatggttgtgatagttggaaattggtaagacattcttaagcaacatataaaatgcaaagccataaaggcacacattaagataattagtaacatgcaaataaagtcaccctatcttctccttccctatgcaacgtcaccccatcgtcttcttccctgtgcagggtcaccccatcttcacccagacccaagacccaatctcccttccctgtggagcgtcaccccatcttctccttccctgtgcagggtcaccccatcttcatccagacccaaggcccaatctcccttccctgtggagcgtcaccccatcttctccttccctgtgcagggtcaccccgtcttcacccagacccaaggcccagcctcctttcactcctctccactctccatcactccatttggatttccctttgtgtgacaactcatgctgcaagctttttgctactgtctttttcatagaaaaatccatgttcttgttccttatttcatatttatctttctactcacataagattatacaatcatttcttgaagtcaggcccttaacaaaggagtaactaaaaatggctttcgaccctggaaataccagagaaggctttttgccttttgcttttttttttctttatatcagcctatctagcgatgtcctgaagcaatataaatggccagcattgttccagtactccagcattccattcacgcttatcgatctgatattcgtagtgaaaatcccacttttcccccagtcacttgatctgtaagaggtgagaggaaacttcaaagtgattgcactgagcttccgtggcttttacgcggattttagaggaagctgattaaacggtgataagtactttcaaagtttcaaatgcgatttctgttctaagcccatattaataagtcattttaatatactgaacaaaactacagatgtggctagaacaaagaaacattttagaccaaagctcatgtatttatccaagtgccaaatccctttggctggactgcttgtcttttacaatgcctgtgatagagaccagagtgtttagaataggacacttatgtgacaagcctttcacaattaattttagcttagccataccaaacataaaccgtaatagtattcctggaaaggaaatgcgtaaccatcacgaataccagagtttttaagacaaaatagtttaatcagagtcagggtatcaaaaacacagagagaaaagttgaaaaattccccaggaatttaaaaataatttgttcatttggcctgcaaaaaaaaatgcacttgttctgaaattcatacatgccaacattatgcctaaaatacagaagagatagaagaaacgaattgaaatccattgactctgtaaaaattgagatgacactggctggatggactgttaaatataagattttggtacttatcggagatgacggtgagattaggactaaaatgagacaatagaaatattatggggaaacgttatattacatgaagttctgaaataaaaacattttggagaacattaatctggcacaaaattttatgcatgttaatgataaaacggcttttcaatgttaacttactggaaaataaaatattctgtttgtgaatcagtggttaactggtgtcatgagggagctgctaacctctagcagataggctgcaggtgatctgaacgcaagccaatcccatctagatcatggagaaagcagggtagtgggaggaatggcaccaaagaattaaatgttaaatgcttggaaaactaaataaggcaataattcttacaagctactctcaggtgagaatccaattacgataccattattatgaatacattttccttttattaaatagaaataatttaatgaaggagtgcctttcattttgagcctcatcgtgcagctttgtgcaaagtggcctatgggtgtcaataaataggaactaaacgtgactatgttcttggaggccaatgagatcatctatgtaaagaaaaggcagaatgttggaaatgatcattttatgataatgattaaaatgataacttttaattattcatactccctgcctatttaagaagctaattcctttcaagaattaggccttgagccacaacagaataaaatataaagctcaatttgctttttctagtaaattacaatggactagaatgtaatataagccaatattttttaaaaatcagttgtgttgtctttctccagacctgccaatcaatcacagagaaatagtatgtattcttccctctctgattccgttgagtctagatagttttaaaggcatttacattagatcttcagggctccacacaagtttaagtaacttatttgctgccacaaaaaattaatttcatagatattctaagtaaatgtccatgtttaaacagcttcacatttttctctttttcaatgactctaattcttggacaaaacatatttctctttacaaattcatttatgcattcataaaaattcaaatataaagttaaagtttgggatattttaaaattttctatatcttataattcagggtagacattatggaaagtatggaaataagcactttagccaacaaattcttcaaagcaggcattctactctgtgtattttcaccagagcctgtggggagttccagatcagaaaacccaatttatctgtcactgctgttgtcttggggaaccaggatcttttgcaagtttaagacccagtgaacttcttacatttccccaaagaaataagattgaattttatgtaaatatacatccaatgacatttaagcttacctcatgtgccacaaaaactataaactagggtcaaacagagatattaccttttaaaaggggatacatattcaaaatgaaccaatacttttttctcagaaaaatagctattgcaggagaattctaacaaaaaagataaggtcttatttcttaaaacattaacatttagactaggaagcatcaaaggacatctcagagactagggcagctcacctgaaaggtcattctactgccaagttttggattacaattgaattcagcttctgaccccagaaatgaagataaatggtggactctctgcatgatgttaacttatatttttgaagaaagtcttgttacttttttaaactttgttctgtatagtgcactgactcctttagcatgtatcttaaattagcttgcttataatattctttctctctctttccctctcttcctgttaaaatgaaaacaaagtactctgaaaaattagaatgaactacagcctcattaatgtatgtgtatgtgcatattgcatctgtgaatgaaaatttgtaatgtaaattaactgataatttaagatgaatactcagttcattattactttggttttagcttttttctagaatctccatttatagacataataattttctttttacaggatacagtctgatttctaccattctcttgctcttaaaaaattattatctcaaaggtcaataatgacattttaattaccaaatgtagtgactgttattttcattgatttccttattgttttcattgattacctgcagcatttgaaacacttgccttcattcctttttgaaacatgtccttctcccttttctttctttttccttcctccctccctccctccctccctccctccctccctcccttccttcctccctccctccctccctttcttccttccttccttctttccttactgcctgtctttagcttactaagggcttagaaatttgaagcccagcaaaccaacagtgatacctacataccagttgtgcaaccttgagcaacttgctacctaacctgtctaatcagtgtggtgtcagcttgtgatgtcaagattgagcttaaatgcttaaatgcttagcttaaatgcttctgtcaattgaaaaaaaaagatataaagaaaatggtaatacgtgcaataaaatcctgagtgttgaagccctagccactcttgagaggttctcaaactaggtagatggtgggaggcctggacacatcgccacaaaccaggttcaggtatggatgggtcttagccctttctctctcctggactcagtggctgaatttccaaatagatatcatcttgtgaaggtgctgctaccattgcagatgcaaaaatagccatgaactcgggccgagcacagtggcttatgcctgtaatcctagcactttgagaggccgaggcagagggatctcttgagaccaggagttcgaggccagccttgccaacatgatgaaatctcatctctactgaaaatacaaaaattagtcaggtgtggtggtgggcacctgcactcctagctactccagaagctgagacaggagaatcacttgacccttggaggtggaggttgcagtttgccaggattgtgccactgcactccagtctgggtgacagagcctccatctcaaaagcaaaccaaaaaaagccatgaaatcagttttctcatctcttcatcctggggacttgagagctctctttccctcttccttgctctgcatgtggaatgttatgaaatcttgcccttctagctgccctgtgtgcccctccataattctcctgccaccactctcatagctgccctgtgtgcccctctgtaattctcccgccacagccacaactctcatagctgccctgtgtgcccctccgtaattctcccgccacaactctcaccacagggctcactttcttttgccacagctattgtggtatcttccatatgttccctttccctctaatctttccagtcttgaacccaacctctctgtggctgccaggtgtcaagaaagaaaactccattcaggttgttcccctacaaatcccacccccacctgccactatcggcactgctctagtgatgacttctgccagcataccacctttctttcttctttctttttttgacagagtctcactctgtcgccaggctggagtgcagtggcgtgatctcggctcactacaacctccgcctcccgggttcaagcaattctcctgcctcagcctcctgagtggctgggactacaggtgcgcaccactaagagcagataatttttgtatttttagtagagacagggtttcaccatgttggccaggatggtctcggtctcttgacttcatgatccacctgcctcggcctcccaaagtgctgagattacaggcatgagccagcgcgcccagccgcataccaccttcctatgctgtgacccccacctgttttagcatcttatctacttagtcactcattgatttcatttaatatcatatacatatgtactgagggcctactgcatgtctatagttatagtagtgacacacatcacatatgagctcccacttccatctcacttacattacaaaaaggagaggttgatgacaaacagctaaaagaataacaaaacaggacgatgcaatagaggacgaatgaggagagaaggatccatttcagatagttagccagtgatggcctttctccagaacagacatttgagctaagatctgaatgtaaagaggaagccaaccacgctaagtttcagcagaggcttccgggcagaagggaggcagaaacaaaaccccagtgcgagccaacatcaacatactatacacactcaggccaaaactggactcctggctgattcatgactcttgctttgcaacttgtttccattaatgctgttgttcatgatggttcctctactccaaccctttttgttaaaatccatccgtcaagtcctaattcgaacgcaaccctgaagtttccctttttcatcaaaattacgtgcattcttcctctccattaagacttgtctcattcttggagttttatattctgtcactatgtacttatctgtgtgctcagctcatgcccctagcaaagtgtgtgttaccggaggacaagatttaaaataaattattggtttttgttctgtatggagtctgatataatgttttaagtacaagaatttttcaaaaagtatttatggaatttgagaaaatgtgcacacttatttaaacatcagactaccatttactaacatttgtctgcagtgatcatggcttccaattaccctctagaaaacatccaaagtgcctcacaaggatgcagggcttttgcgatctggcccccaccttcatgttgcagcttcaaacttgtttacactgggctttatttccctgttatccagctatgtttagctatttttatttctcataatggagcatgctatctgtccatattcacctttgcacatgccattgagttggcttggactcaccgtccactcccagccaccacaaatctaccttctccgttgctcccgcctggatggtagtctaggacttcctatgccagcaccagactccccagaaagcatttcttttcctgtctctgcccacatgtggattagcagcccatcttatgtgtttcctaaagcctcatatttatccctatcccaacactgaagaaagtgtggtgatctactcatttatttacttctcctaatgcactacaaggttctcgaggtaggaagttaactaagttctccctctcattcccagtgatagcacagttcccagcatatagtgagtgtttaataagtatctttgaaagaatgaatgagctgatcaatcatgaattccgcaagagcatcttctataggccactgcatcctcactgcctgggacagtgcttgattaatcatgaattctgcaagagcatcttctataggccactgggtcctcactgcctgggacagtgcttgatcaatgatgaattcctcaagagcatcttctataggccactgcgtcctcactgcctgggacagtgcttgatcaatcatgaattcctcaagagcatcttctataggccactgcgtcctcactgcctgggacagtgcttgatcaatcatgaattcctcaagagcatcttctacaggccactgtgtgctcactgcctgggacagtgcttgatcaatcatgaattcctcaagagcatcttccataggccactgcgtcctcactgcctgggacagtgcttgggtatatggtcagcactcaataaacatttgttaaatagaggactaaaatattacaattatgactgtctattttcctctattttttcacacttgtgctgtgtatttaaggggactgactaggctgaggtgaatagactacagtgccttctctccaggaactcaggatcttgttgagacacaaaatactttaaatatgacaagctgataatatcaactgtttatagataactcataactctaattgacttaaaaactacatagtggaaacagcatagaacatgaattgaaacaaaactggatttagttatggtgtgattgtctaatcacattttacatttctcacctttggcgtcagccaatgtaactgaggatattaaggtattttggatttggaggacgatgtgcctggaaatatgctaaggcattttggcatctattctctagtcattggggcaacaataaaatattaaatattctttccaaaattcaaatgtttgtatttgtaacatttattcctgatgctgtatataaagtataatgctaattaaactacagtccccattctcgagtgggcatttttgttttgggttatgactggaatagtctctatttcttatgaactacgtggatttatccagtgaaacttccttcagaaattatataaggctgttaggatgcaggactcactgtagcaccagtatcatttcttccctaaacatgaattatcatttaaatttacttcttaaacaacgcttttcatgagtgaaaaatggcatatgtcatatggataaagaatcaccgaatgacatcagtgtatccaaaaccattgcggaaagataacttgaaagtactggattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgcagtgacaggcgcctgtggtcccagctactcgggtctgaggcaggagaatggcgtgaacccgggaggcggagctcgcagtgagccgagatcgcgcccctgcactccagcctgggcgacagagcgagactccgtctcaaaaaaaaaaaaaagaaaaaaaaaaagaaagtactggattaagtctaacgccttaagaggaggcggatggtttacatagtccttgacactggaaacatgtctcaatgacactgtatgttttctctctttagttttcacttcattttgatccatcgcttcatgtgaattaaacaatgggagcaggtggtatggaagtcctgatttgaccacattc
